United States Patent 10,407,724 (METHODS AND COMPOSITIONS FOR SCREENING AND TREATING DEVELOPMENTAL DISORDERS) - sequence listing, part 41

SEQ ID NO: 633 - DNA, 4538890 bp, Homo sapiens (residues 3,025,929-4,538,890 of 4,538,890)
  misc_feature (958203)..(1008202): n is a, c, g, or t
  misc_feature (1689175)..(1869174): n is a, c, g, or t
  misc_feature (4240901)..(4290900): n is a, c, g, or t
cagatagaaaccaagtttctatgttggttatacaaggcaatgtgccatgggatcataagaagattactggacttaggatctagatggaaccatcaggagatatgttcaaaacagcagatagggtaacactaaccgaaggaaaagaactcagggaaagttgctaaggcattattacagcagggaccactaccatgcagccccatggtcttcagtatcaactagccctgggtttgcatctttgatctgagtagtagccatatgatgacaggaaagttcatcaatttttctgagactcagttttcccaattttaaaaataagaattgtagcacttacgttgaaagcttgttgagattaataaataaatgagaaaacatgaagtactaattaccttataagtggattgtgagtgtatatatgtgtatatatatatatatatatatatatatgtataatttgcaaagtaaaaaccataattttaaagaaatttatttctacaaacatccataattctggtcctgcgttttcaggtgtgatatcattttcttacaaaataaatttagttaaaaagcaaaaggtgtaaaaaatggcagactaggaagctctaagccctcatactcccacaaaaacacccaaaaaaacccctaaatttgtaggagctcttgaaaacagtgaaagatttacagctaccaagctaacatcaaattaagaaaaaaacatttttgaaaggatagaaatgtcttttggtacttttcacccctgctccatcccctcttcagtatggcagtggtcttaccttaagcaggcagcaccctggttcccagttacacccccacttaaaaggagggaatagggcatgtcttatttgcaaattgtatgtgtgtgtgttcacatctgtctgggagatatctgaagcactgatgcaaggcactcatgtgttttgaccctcttggaattaacatcagtccttctcaagctcttccataaagctgaagagaaagaaacacttcctaactcattctatgaggctgatacaaatagagacaaagacacaacaaggaaagaaaactacaaactaatatctcttataaattgtcttagtccatttagtattgctataagggaacacctgaggcttggtaatttataaagaaaagaagtttatttggctcacagttctgcaggctatacaagaagcatggaaccagcatctagttttggtgagggctgcagattgcttccactcatggtggaaggccaaggggaaccagcatatacagagatcacatggcaagagagggaaaaagagagaagggaggaaggtgccagcctcttttaacaaccagctctcatgagaaatacaagagtgagaactcactcaccccgaccccaaccaagagcattaatctgttcatgagggatccgccttcatgacccaagcacctcctattaggtcccacctccaaaattggggatcaaatttcaacatgaggtttggagggataaacatacagaaattctcaaaaaaaacactagtaaaccaatttcagcagcttgttaaaaggattatacactgtgaccatgtgggatttgttcccagaataaaaggatggttgaacatacaaaaatatattaatgtaatataccacattaatagcatgaagaaatggaaccacatgatcatctgaattaatacagaaaaaaagcatttgaaaaacattcaacactctttcatgataaaaacactcaacaccctttcatgataaaaacactcaataaactggaaatagaaggagacctcctcaacaaggtaaagactatttgtgaaaagcccacagctaacatcacattcaatggtgaaagactgaaagctcttcctttaagataggaacaagataagaacgcctggttaatccacctctattcaacatagtactggaaattctagctacagcaattaggtaagacaaacaaaaacaattcaaatttgaaaggaagaagtaaaattatctccctgcatagaaaacacaatattatgtgttaaaaaccctgaagattccacaaaataagattccaactaataaaccaatacaacaaagttggagcatacaaaaatcatttacatttccatagactaacaatgggaaaaaataaagaaatcaagaaaacacttcaatttacaataacatcaaaaagagtaaaatgcttaagaacaaatttaactgaggagtcaaaagacatacacaggagcagagtaagaatagaagcctccactgatcattcctcccttccacaggaacaccaaattttaacaagcaactatacacacaaaaaaagcaccattataagaaccaaaaataaggtgagcaatcacagtacctgattttaacttcacatcactgaaagaggcactgaagagggtaaggaagacaatcttgaattgcttatgccacccctcccccatcccccagcaggagccatttcacatggagagagaatctgtgcacttggaggagggacagcacagcaactgggggacttgatattgaactcagtgctgccctgtcacagtggagagcaaagctgtgctgagctcagctggcatccacccatgaagggagcatttggaccaccctagccagagaggggaatcgcccatcccagtggtgggaacttgagtttctcagcaagccttgccactgcaggctaaagtcagagtcctcatgaatgggattagtgcccttataaaagaggccccagagagatgtgtttcctcttccaccatgtgaagacacagtgagaaggctgtatttatgaaccagtaaatgggccctcaccagacactaaatctggcagcatcttaatcttggaatttccagcttccagaactgtgagacgttgatatctattgtttataagcttcctggtttatggcattttgttatagcagaattaaaatatggactaagacaaaaaatggtaccaagaaatggaggtgctgctctaacaagtacttaaaatatggaagcaccttcagaactgggtaacaggtagagactggaaaatttttgaggtagatgctaggaaaagcctacattgccataaaagggccttaaatggtgacgctggtgaggtctctgaagaataggagagctgtagagaaagcctcagtcttcttagagaatatctaagtggtcgtgaacaaaatgttggtcgaaatatggatggtaaaggccattctgatgagactcagatggaaatgagtaacatactgttggaaactgaaggaaaggtgatccttgttataaaggggggaaggatgtggctaaattttattcctgtcctagtgtttgttagaaagtagaccttacaagcaatgaaatagaatatttggctgatgaaatttctgagttaagtattggtggtttggtatgtcttctcttgaatgcttgaacatcatgagaacatcaatgtgtgtggccaaccaactatttgataaggagattagtatggatcagcctggtgctattcatcaagataatggaagaatgaccccaaaggcatttcagagatgtgctggccctcccttcacaggcccatagttctagggccttgcaggcagtaagattttgaagaaggagctgaggcatccatgggccttagtgcttgctgcccaacactgcctcaaggatctgctctctgcattctggctcagtgcaccttggtcatcccaggtgtggctccagtggatccaggtacagtatgggctacagtggccactcctccagagggcataggcagtaactcctggtggcacccacttggtgccatctttgctggcatacagtataattgagctgtgggggtatgattgcctgcaaatggatttcaaaggatggagccacctggaagttagagcatacaacccaggcagaaggctgctgtgaggtcagggccactgcagacagtccccaccaggacaatgcctagtggagttgaggaggtgaggcccccactctgatctcagactagtagagctaccagcttgtgattacagcctgggagagctgcaggcaccctactctaacctgtgagagctgcagtgtaggctacacattgcaaagctgtgggggtggggctgctcaaactcctgggggcagggatgccctgaacattgaaggcccaattcatgccagcaagtctgtggaggtgggacccccaacccagtgggcctggaggacagaccctcaagtcaaagatagagtactaaggttttagacttacttggggttcattagctctttgtttttcctatttctcccttttacaataggaatatctatcccatgcctatcctacgattgtattttggaagcacataacttgtttgattttataggctgacagctggagagcaatttgccttgggattaattgaacctttaatctcacccatatctgatttagacaatatttaggaaagattttggatattttgagttgttactggaatgagttaagactttgggagctattgaggtgtaatgaatgtattttacatgtgagaatgacatgaatttggcagggacagggattgaatgctatgatctcaatgtttgtattttcccaaaattcatatgttcaaaacctaatcaccaatgtgatattagaagatggggctgttgggaggtgattagccctcattagtgggatttgtaacctaataaaagagctcccagaaggttgtcttgcccctttgccatgtgagagcatagcaagatggttgtgtccaccaggtagcaggccctcactagacactgaatctgtctgtgccttgctcttgaactttgcagcctccagaactgtgagaaataattttttgttgtttataatatgcctgttattgcatcctgagcatactaagacaattactaaaatatatgccaatgttttatactttgataagacaaaaagtaatataccaacaaaaccacaacttggtaagaagagagaaagaagaaagcataagtatgctacttaacttatttttcacaaagaatacatggacaccatcaaaagttgaaatgcacctttaagaatgaaaaacatcagccttttattgtttttctactttaaagggacttttttagaaactaaaatataatattttgaggaaaagaaagaagccatacctttatgtccaaacaataaaaatctttctgtataaagaatcacataaatttggataatattttatctttctgcataatttagaatatgaaagtacataattgctttcaaaaagttacccattttatactcttcttattcctttgacagcatcaatttaatttttgttaagtatcacatgcactttagttatatttatatgtggcaaaattattattttaaaaataagagcaccaaagctatggcattcaattttgccagtgattgtatttttttataaaagcttaatttgtggaataacaatgtttaaatcacattaaatatccactttaaacttattactggcctgtagaatatttttacacagtttaagagctgtatgtagaatgatatctctgtgcttactttcttcacatattaggcttttcctcaaactttttggagaacaagaagttccagaagaggatgctagactttacacagcaaaactccaaatttcttaacacagaatacattacagtgatccaaaaaattagctgttatgatatttatgattatcaatgatatttagaaaatattatattgtctaggtattcctaacaattaggaattatattttgattccaatactctgttcaaaaagtggctttccctttacctaatttctgacatggctgggcgaagatggagttccagaaaaagagacctatatattttagatgagatttctgatttcaagcaagtatcaagacaaatgttaatggttcttaatttgatgagattgggcatgttcagggtggtacagcccttgacgagggttcttaatttgataaccaaaaaactactgtgtgaaacaaaacacatatccacaatattttgaggagattgttcaggtgtccttatagcttgagaagtctgtaatagctggttatcaaaaaagctaactcacccattggaatgtagtatttgaaatcgatatctagacagtcctgtgactaataataatattaaatttgtagtttaaaatcttcataaaaataaatctctaaacagagatggcttcactgacaaattctacaaaatatataaagaaataacatttttacataatcaattcaagaaaatagaagtggagtgaacattttcaacctcattttaacaacacagaattaccctgatacaaaactagacaaagatattacaaagtaagaaaactatgagccgttttccttcaggaacatagatgcaaatttcctcaaaaatattataaaatagaatccatcaatatctaaaaatagtgatgcactgtaatcaactaggattcagatattcaaggctgcttcaatatcagaaactcaatcaatgtaatccatattaacagaataaagaagaaaaattacatgattagatcaattgatgcagacaaaactttcgacaaaatgaaacacctattcatcatgaataatggtcatcagtaaacaataaatggaagggaatttcctcagcctgataaatagcatatacaaaaacctataggtgacttcatacttaataatggaatgcttatacttttcctctaaaatcagtaacaaagaaatgatgtcctcattcactactcctatttaacatagtactggaagtcctaggcagagcaatatggtaaaaaaaaaaagaaagaaagaaaaaaaagaaaattaaagacatacataacaaaaaaaaaaacttccgatagtgaaagattacaaggttttctactgaaaactatcaaagaatcttatttaagtctttaatttttatcgattcaaggagtacaggtgcaggtttgttacatagacatatatgtattaggctgttcttcaactgctatacagaaatacccgatactgggtaatttaaaagaaaagaggtttaattggcccatggttctgcaggttgtacaggaagcatagtagcatctgcttctgaggaggcctcaggaagctttcaatcatggcagaaggaaaacaggaagcaggcacatcacatggcaagaacaagagaaagagagagacagttggcaggggaggttccacacacttttaaatgaccagatcctgtgtgaactaacagcaagagctcatttattaccaagggaatggctcaagccattcatgagggatttgcctcatgatccaaagacttcccaccaggccccacctccaacactggggattacatttcaacgtgagatttggatggggacatccgaactatatcagtgaacactgtacccaacagataatttttcaaccctcctccccacttccccgtttcggagtccccagcgtctattatttccctctgtatgtttgtgtgtacctgttgattagctcccacttataagtgagaatatacagtaactgatttttgtttctgagttatttcacttaggataatgcctccagctccatccatgttgctgcaaaagacaatattttattcttttttatggatgcatagtattccatggtgtatatataccacattttctgtatgcaatcaactgttgatggacacttaggttgattctatgactttgctatggtggacagtgctgcagtatgagtgcaggtgtctctttgaggcatttattttcttttggatatatgcccagtagtgggattgctaggtcaataatagttctatttttagtccaaaggatccttttttaaaaagctgctacaattaataagtgaggttaccagggtgatacaagtagccctgtggccgccaccactaggactgtgctgggtcagacctgaagccagcacagcactgggtcttgcccaaggcctgctgtaaccactccctggctactgcctttgtttgctcaaggctctggggctctacagtcagcaggtagcaaagccagccagacctgtgttcttccctttagggcagtgaattcccccaggcctcaggcaggtccagaggtgccatctgggagccagggacaagagccaaaatccttagaaatctatctggtgatctattgtgctgcagctgagctggcactcaaaccacaagatgcagttcttcccactcttcctcccttttccaaaggcagaacagcctcactctgtggccaccaccaccacaggcccacagagagtagtgccagactatcgctggtgttcccttaaggcccaagggctctccattcagcttgtggtgaatgttgcctggcctggaactcaccgttcagaccagtgggttcccctctggccaagggcaggtccagaaatgctgcccaagagccaagtcctgcaatcagggatgtcaagagcttgcttagtgctctatcccactgtggccaagctggtacctaaggcgtaagacaaagttccctttacttttctctccacttttctcaagcaggagttttgccccatagctaccacagctaagaatgtgttgagtctcacctgaagccagaaagtctcagagtctcactcaaggcccatggcatactatctgggcatcactgctgcttattcagggcccaagggctcttcagttagcaggtgatgcgttctgccaggactagattcttcccttcaaggcagtgggttcccttctggcccagggtgtgcctagaaatgttgtcttggagctagggcctggaatgggggcctcacaactctgactggtgccctatcatgctgtggccgagctggtatccaaggtgcaagacaacgtcctccccactcttctctctcctctcctcaggtggaaggaaggggtctcttttggatctgggagctatgcagcctgcctttaggagaggggtggtgccagaactcccttagccaccctggctggtgtctcagtaggtcacatgcccagccccagaatactggctctgggcccagtacaaaactaggacttgactaggagttgcagtccttgtggcctagactctttcaagtttacttaggaccctgctgtaggggttggggggtcctttaatccgttttggtgaggcttgtgggaattcaagttctgactgccgggttcattgattcccctctagctagggctggtttaaatgctccctccgtgagtggacatcagcaagtttggtcccgttttgctttctgctataacagggcagcattgagttcattgcctcacaactgttgcacaccccctctcctcagtgcacagaaatactctccacacgacactgccactgctgggggacaggagtgggtggcactggtgtttcaagactgtttttctacctcttcagtgtctcttttagcaatatgaagttgaaaccaggtactgtgagtgatcacctgatttttggttttgctgaaggtgtttctttgtgtagataattgttaaattagtgtccttgtagcgggggatgatcattggggccttctattctgtcatcttgctccacttcccatgatcacttttgtcagcaggcagtgaatcctgccaggactgagtctgtctcaccagggtaatggattcccttctggcccagggtggatctagaaatgccacctaggagtaaagacctataaccaggggcttcaggaatctgccttgcactttattgtactatgactaagttaacacccaagttgcaagacaaagttttctttactattccctctcttcccccaagcagaaagagtctctcctgcagctgcattacctggagatggggaagtacccaagtactcccttgcctgtcacaggcgatgtcactctgagttacaccccaagtctactgcctcagtgaagcaccagggcttgctcaaggactatagtacttgtggcctgacagccactcaaatttgttcctggccccaggctacttcagtcatccagcagtacagccaatgagacttttctcccactggggcagggaatttccctctgtcttaggactggtctaaatgctccctctttgggcaccaacagcactctgccctatattgtgttccactgtgccagggtagcactgagtttcaatgcaaagtcccgaactcactttaactttccctcctccaagcacacagattcttactccatgctgtgctgcctagggttgggggaggggtgatatgggcaatgcaagactgtctttcctacccaattcaatgcctctttccttgatattatacttaaaacaggtactgtgattgctcacctgatttcttggttcttgtgaaggtgccttcttgcatggatagttgttcaatgtggtgtttctttgggatgatgagcactgaagggttcaatttggccatcttgttctgcccaagttcctaaaatttgatgtctttttagcaaaaggaagaagcttctcatccccagtggtagcagcgttcctaccctcatccacagtggtagtggcctttctatctctgtctcaagagtttaattctgcattgcctgaggaaacagtaatggcctcccctgaaggagttgacaggctgattcttctgaggatccacctttaccacccctttttgcttctagatctataactagattcaagtctcatcaggcccctaaaggtgagacacaaagtgtgacccatgaggaggtgtgctacactccacaataactacttcagttttctgatttatacaggcagaaatctggggaacatatgcaggaatggacattaagggtgtagcataatggtggaaaaaacatgaagttggatcaggtcaaatttgttaatatgggcccactaaccagagattatgcatttaatgttgcagcttgagacattaaaaaagagtgctaatactttggcttgttggctaaaatgcagctgaaaagatggcctattatgagtgagctggaaatgccagatctcccttgatttatggtagaggaagggattcaaaggcttggagattggaatgctagaatggatttgtcacataagacctactcacccaaacttggagggtccagatgatatacttttcactaaagtgaaaatagatttgtaaggggagcaccagcatctttgaagaactctgtgattgctcttctctgtataccagacatcacagtatgaactgctgtaactcaattggaaacctaaatgcaatgagaataactggacccctgccaactgacagcactcaaccaccaaaggcaaggtggacatggttatcgtaatggacagcagaggcaaagcaataatcagaatagtctgactcatgtagatctatggtgttggctagttaatcatgatgttcctagaagtgaaatagatagaaagcctactacattcttatgtgatctgtagaagcagaaacttccaggtcaagtgaacaaaagtctaacttgaatcataaagcagagaatcatgaccccaaatcaatttccagacttgagccaatttacaaaccaagaacttgaacaaaggggaggtcagctccccttgtggaaggaccccagtatattatcaaaaatttatattttgttcatctttgttccatttttgcccaaagaccttttaccaaggtaactatgcattggggaaagggaaataatcagacctttgggaactgccagacactggttctgaactgaaattgattccaggagacctgaaacatcattgttgccctctagttagagtaggagcttatggagatcaggtgattaatggagttttagctcaggtctgacttgcaatgtgtccagtgggtccccaaacccattttgtggttatttccgtagttccagaatgcataattaaatagacatgcttagtatctggcagaatccccacattggtcccctaacctgtggggtgagagttaatatggtgggaaaagctaaatggaagccattagagttgcttctacctagaaaaatagtaaatcaaaaacactactgcatctctggagggactgcagagattaatgccaccatcgaggacttgaacgatggaggggtggtaattcccaccacatccctattcaactctcctatttggcttgtgcagaagacagatggatgttggagaatgacagttaattatcataatacttcatcaagtggtgattccaattgcagccgctgtaccagatgtttcattacttgagcaaattaacacaccttctgctacctggtatacagctattgatcgggctttgagtcctgctaccagcctgtctggttcttcagcttgcagactacctatcgtgggacttcaccacttctgtgattgtggtagcagattccccctaataaatttccttccatacattctactggttctgtctctctggagaactctgagtaatacaatatccattcttttgcatgtgaatatccagttgtccctgcatcatttttgaaaacactatcttttcccccacaaaattatcttggcccctttgacaaatttacttcttcctttactttatcaaagagtttgtgaaggattgatattaattcatatttaaatgttaattaggattcaccagtaaatccatctagacctgggtgtttttgtgtggcggcggggggggggggggtttgaaattactaatttaatctttttatttgttataggtttattcagattttctatttcttcttgtgctagtattggtaatttgtgtcttggtaggaatttatctatttaagttatataatttgttggcatatacttgtttataggtttccttatgatactattaatttatataagtttgtttgtgttatcttctctttcagtcctaatgttactaatttatgtcttccttttttgttggtcattctagccaaaggcttgtcaatttgttgatcagatttaagaaataacttttggttttgttattttctatttagtttatttgaagtctaatgttcattttttctttccttctgtttgcttttggtttagtttgctcttcttttcctactttattaaggttaaaggttgggttactgatttgagaacttttttagcattttatagaaattattttccttccaaacacgcttaaggtgcatcacataagtttggtatgtttttttattttcattcatctcaacatcttttctaatttcccttttgatttattctaaaacccactggttgtttaggagcacattaatttccacatatttttgaatttacaaattttccttttactactgatttctaatctcactctactgtggttgaaggacatatgtatataatttcaataattctaagtttattgtgggttattttaaggccttgcttatatactctcctagagaatgtttcatacatgcacttaggaagagtgtatattcttctattgtgctgtaaattgatttacagatatgtgttaagtttagttggtttatattattattattcaagttttctatacctccgttcttttgcctagatattttattcattattcaatgtgtgatattggaattctcaactatttttttaaatcatatatttatttcttcaattatgtcatttcttttgcctcatgtattttgggattcttctgttatatgcatgcacatttataattgttatattttcccaatggattgatattttatcattataaaatatctctttttatcgctatcaacatttttgaccaaaaaactattttgtctgatattagcatagcccctccagatctcttatggctgttttcgcacaacatcggtttccgcctttttagtttcaacctatttgtatctttgaaagcaaagtatgtcttttgtagacaccataagtaggattggatcttgtttttctatcagacaatctctgccttttgattggatagtttaattgattcacatttaatattattattgatatgctttgatttatgtttacaattgtgcttttggtttctatatattttgtgtcttttgtgttcctctagtccttttttctgtcttatattaagtagttattttctagagtaactttttcatttctttaatggttttcactacattttttagcaattttcctggttgttgctttgacttatggattatatgtcaagttaaactacttcaaataattccaataagatagaaaatcttagttcctttatagcttctgtacctcccaccccctttgcgatattgtatatactacatctattcatattacaaaaaacaatatagtattacaattattgctttacataattgtgtgtcttttaaagaaggtaagagaataaaggagaaaaaaatatatttataccatttttatattaaccttatttaccatttctgtctttgtgtatttctcctgatgaagtcaggttattgtgtggtgatatctctttactccaatatatttcatgtctgacctccttttttgttctgttattgtcaaatatattgtatttctatatgtaatatgtcaagtatataattttatagatttttatgcaatatgttcttttttttttttttttgacggagtctcactctgtcaccaggctggagtgcagtggtgcaatctcggcttactgcaacctccacttcccaggttcaagcaattctcctgcctcagcctcccgaatagctgggactacaggcaagcgtcaccacgcccagctaatttttgtattttaagtagagacagggtttcaccatgttggccaggatggtcttgatctcctgacctcgtgatctgcctgcctcggcctcccaaagtgctgagattacaggcatgaaccaccacgcctggccgcgatatgttcttaactcagtttacaaacaaggaatgatacaatcttttatacttatctacataattatttttaataggattctttgttttgatgtttagatttaaattattctatagtgtccctttctttcagcctgaagaactttctctagtatttcctgtgaataggaaatactagcagcacagctctgctagtatgttagtttcctatggcttctgtaacaaattatcacaaacttagtggcttaaaacaacacaaatgtattatcttattgttctggaagtcagaagtccattcatcttactatgccaaaatcaaaatgttagtagggctgtactgtctttggaggctctacaggaaaacttgctttgttgcctttccagcttcgaaacatcacctgcattccttggctcatgaccccttctaaccttcctcaagtccatcactccaacctctgtaatcataggttactgggattaggacatggacatctttggtggaccatattctgtctaccacagatggcaatgaaattatctcagcttttttgttgttgtttttcagggtatgtattttgccttcacttttgaaaaataattttgttgtatataagactattagttgctttttttccttaaacactttgaatatgtcattccactgccttctgtcttccatgatttgtgatgaaaagtcacctattattcttattgcaggataccttatatatgatcttcttctcttgcaaatatcaagagtttatcatgtgtcccatatttctctgatgctcttttatctttattcttgtttctgtctgttcttcagattgcaaaatctattgttatatctttaagtttactgattctttcttctgccagctctgatctgctgttgagcacctcttgtgagtttttatttaagtgtacttttttagtttaaaaaaaaaaaaaggatgctggtgaggtggtggagaaaaaggaatgcttatacactgttggtgggagtgtaaatcagttcaaccattgtggaaattcctcagagacctaaagacagaaataccatttgacccagcaatcccattactgggtatatacccaaaggaatataaattattctattataaagacacatgcacatgtatgttcattgcagcattgttcacaatagcaaagacatggaatcaacctaaatgcccatcaatgatagactggataaagaaaatgtggtacatatataccatggaatactatgcatccagtataaagaacgagatcatgtcccttgcagggacatggatggaactggagaccattattcttggcaatccaaaacaggaacagaagaccaaataccacgtgttctcacttataagtgggagctaaatgatgaaaacacatggacacatagaggggaacaacacacagaggggcctattggagggtagacgatggagggtggaagaagggagaggatcaggaaaaataacaaatgggtactaggcttaatagctgggtgataaaataatctgtaaaacaaacccccaggacacaagtttacctatgtaacaaacctgcacatgtacccctaaactttaaataaaagtttaaagaaattctcactccttcagggattatgtaaagagtttttggcattcatttaagaaatcaacagttgatctagttataaaccaattgaaagaagttgtaaaataagttgatgatggaattccattgtatcaggagaatatcaccaatgctttttacaaatgcctttatgcagccatgatgcaaaatgaaatcaataaaatatcaattattgcaaagttaaaaatagtgtactttttgactaatttttgaccaaaaagaaaactctgttaaatatttcaataagtttattctgagccaatgtgtcaccatggcccagggaacagtctcaggaggtcctgagaaagtacacctgaggcagtcaggttatggtttggttttatacattttagagagacagaagttacaggcaaagacataaggtatacattggtttagcccagaaaagcaggacatctcaaactgagggggacagcttacaggtcataaatggattcaaagattttctgatcggcagttggttgaaagagttaagctgaagacttgacatcagtaaaaaaaaaaaaaaaagaaaagaaagaaatgattgagttaagataaggggagttgtggaaaccaaggttcttattatgtatatgaagtccccaggtagcaggcttcagagggaatagatggtaaatgtctcttttcaaaccttaaaataggtgtcagactcttaatctttcctagattcaggaaaggcctagctgtattaatggggattctctacacatgcaaaatttcctccaccaaagatggctttgcagggccatttcaaaacatgtcaaaaaaaaacattttagggtaaaatatttttattttcttcagggtctactatctttcatgtgacgctataccagagtcaggttgatatttggtatcttattgccaaagagtctgttctgtcagtcttaatatctctattttattaattctggccggttttgcctaaactccaaaagggaggggttataatgaggcatgtctgacctcccttcccatcatggcctgtaatttagtttttcaggttgctctggggtccccttggccaagaggtttatttctggtttaaacttcagattgcaaaatctgttacatctaagtttgctgattcttctgccagctcagatctactattcagcaccactcgtgagttcattttaatacaggagttattggccgagcatggtggctcatgcctgtaatcccagcactttgggaggccaaggcgggcggttcacttgaggtcaggagttcaagaccagcctggccaacatggtgaaaccccatctctactaaaaacacaaaaattagctgggtgtggtggcatgcatctgtaatcccagctactagggagactgaggcaggagaattgactgaacctgggaggtgaaggttgcagtgagccgagattgcaccactgcactccagtctgggcgacagagcaaagctctgtctcaaaaaaaaaaaaaaatacgggtgttattaagaaatagttttaggcagatagagagggttaaaggagttctcggtaaggctttttcttttaatagaaacagctcctgaaacacttcttttctaacagaaaggcgacttgcaaaaaccaggccagcaagcactgacatgcgaatgctggtgattagaaactaggtccaaccaatatggccattcccgccctcttctccttgtcaccacatgtgccaagtgtcatggccacctccagataactctgcatgtacaggctatcatggccgcccacatttgcatattaaaagactatggtgggagggccaggtttttcacgggctacataaatgacacacctggtcaaaccaatcccctgggccctatgcaaatcaaacaccacctcctctagtctcccaatataaccaagtacttttccgccacacatggggttttctctttccgtttggagcccccctccctctgtctctgtatggtggagcttcttccttctttcctgcctattaaactctctactctttaaaaccactccacgtgtgtccatttatctacatcagcgtgagaccaaggaccctggcgttcctacattcattgaggtagtatcattttggtgtattgggcaagaattcatttatcggagtggtgagtatggagtgaacctcaacctcaaatctgtcctttaatctcaaggctcttttcctgctatcccgtcaccaaactttccttctttctctatccagggtctcttactgtctctgtgtgtcaaatgtgcaggaatttttacagttcagggaaacaggtctgttaggaaagatcagcagctctggtgagctcatggtatttctaagccaacatcaccacctagtgaaaatagaaatcctcttcatgaggcacattttttacagtaacactgagcttccttttgcaccactagaaatcaggctctcagctacttctgtgaacaggaaagttctgcctttagcagctaagaagtaaaatgtcttctatagtcaaattttagtcttgatattgtcccataagcaggaaaatggccattcgtttcctatattcctttaagggacctattctgtctctgattcagaccgtacttaattagtaaggggattttaagtttggaagtaaaccagaactatttttctgaaggtaaatgctttagcatggaccataatagcaggcaatctagcacgttgcctccgttaaaggagacttgcccaaagatgacacagtctctccagagatccatttttcagggagccaggcagatcacacaggtttaggaagtcaaaggggatcacacaaggtggataagctaaggttgcatgggtaaagcgtggttagtcccatcacttagttcatctggtctcatggcttggaggaccacacctacaaccatgggtggcacgtttaacagggtgccaggacccaggaaccatggagggaaaataggaggatgctccacgtcttctccaccctgggtcatacagaaaggaaggaaactaaaaggacacttttattctcgcctctctttctagatgggtaacagattatcttcagcttgcacccctctggaatgcactctgaagcactggaacttccttaacctcgggactttgaagagaaaagcgactcattttcttttgcacaaaggcatggcatttttactaaacctttgcaagggttttaaggtcaaccaagcccttttagcaatcatatcaggcaggcccaaagagaatagttccccaaagttagagaagcaatttccaggggaactacctgaggatcccccttatttggggccccttcaagttcccttctcattataggaccttaggcaaataaagggaaacttaggctgattttctgacgacgctgataggtatatagaagctttccaaaatttaattcaggtgtttgacctcacatggagggatgttatgttgctcctaaaccagaccctcatggcagctgaaaagcaagcacctctgcaagaagcagagaatttcggaaatgagcaaaatatcgcctataatacaccaaaaaggaagaaggcagatagatagggaaagtgaagaaataacagaaacactattcccaatcgggagggaagcagttcccagtacacaaccctgattgggaccccaataactcaggagatgaatggaaaaagaagcactttttaaggtgtatattagagggcctacagaaaaccagggccaaacctctcaattactctaaactgtctatgatagaccaaaagccagatgagaatcctgtagcctttatggaaaggctgagagaggcactaataaaacacacctcctatcccctgattcagtcgagggacacctcattctaaaggacaagtttattacacaggcagctcccgatatcagaagggagctacagaagcaatttataggaccaaatagcaccttagaaaacctcctgagaatagccacttcagtcttttacaacagggaccaagaggaggcccaaaagcaagagaaaaagctcaggagaaggacagaggctctggtagcagatttgcaggcttgcaaagtccagcatccccaaggtgcatccgctagttgctatcggtgtggcaggctagagcattttaggaaggaatgcccaggcagcaagatgaagccatctcaaccctgtccagcctgtggcggaaaccactggagatggaactgcccccagagatggaagtcactgggttcaggaccagtctcacagatgatccagcaggactgatgggtcctggggctcaaatctcagctccagcggttcaaactgccattatagcacaagagccctgggtgattctggaaaataaaggaaggaaagtagacctcctttaaacactagatcctcttttctctctcttttatcctctctaatctaggcctcccctcttcccataacatgaccgtaaggggcatctcaggaaaaactctaatccaatgtttttctcaaccttagttgtagttaggaggacctatttacacaggcttccaaaccattgttatgacagctctactaaattaatcctaggaaataatttaagtgtttacactccacatgtggcaggatcactgtcctctagggggagctcttagctagtaaacagccagtaaagcaagaagtacataaggcaggataagtagtagtagctctaaataacgtctctccccagacacaagcactcaattagctgagctaatagctcttacaagagcacttgaattaagcaagggaaagacagctaacatttacactgattccaagtatgctttcctggttctccatgctcatgctgccatttaaaaggacagacattttcttaccactcatggatctactataaaaatatcaccaggaaattaggttattatcctcagtttttcttccacgagaaatagcagggatgcattgtaaggaacatcaaaaggaaacaaataaggtagtcaaaggagatagattagctgaccaagcagctaaatcagaggcaaggaagcctcaaggcatcaacacacttcaagcccctcctaatctaggaaggctccataagaaaaactaaacctcagtattcccctgcagagatagaataggccacttgtcgagtgcatgcttttcatccctcaggatggctagagtcagaggatggcaaactccatttgccagcttccagccaatgaaaagtccttaaaatccttcaccacgcttttcacttaggaaagtattaagacttattaatgtattcaaagattattttcaggcaggaaaacctctaaattggttaagcacgtaacctctcgagctcacttccaacaagaattaacacaactagcagaagcccaaccccaggaaatagaaccacctttatttaacccaggaaatttggtattaatgaaaactctcatctctgtctccttccctaagccaagctgggaaaggccctacactcttctttcaactcaaccccctcggcagtaaaggttacaggaatcaactcttggatacatcacagtcaagtcaaagcctaaagagctgagggagcaacccctgacagtccagaggaacgtcctgaatatcaatgtggagaaatagactatcttaagctgaaaatcacaaaagataagtaactgagtgagggctactcatcttactcagtccccctcctacctcaccagatactgtttattatttctcccctttcctctcaaaatttgccaccaaatattagaacttctttttaatgcatatttgcaaggaaattttaattatacatgggattgcatttgtaactttgtagatccccaaaggaaaatgttatatcttggcaagtaaaattttaaacagaaattatttactatgccactcctgtgggaattgttatagtcacgctactatttgcagtagaactgtacactgtggcacccacaatgtggaattctggttgtaaaattctaattgctgtaatattttgcctgattctcatccttataacaggattaataattgcaggaaagatctagtcaaggttgctttgcttatagcaggagtagtagttatggataagaagcaagcatggaagttttactatcattaagtttaataggactttttactgaaggttggtgataggatgcactctaagctatgaaaaggatatgaaaaacagagattttacataaggaaggatcttgtatggtaaattcttgtcctaaaaggaagtgactggttgtttaaagaaagcatgtttagaacaagtcagaaagtttaagtatgttgtaagagagtatgtgaaagtcatgaaaaaattttaataattaaaggaaaggattgtcaagattaacactaaaattattttagccacccagtaatatatttctccaaattttattgcaagttataaaaatggtctaagcctaaagttattctctaatggcaagttaagggggaaaatgtatgctcttctcaaggaaaacgttagctttatatgaacgtttctggtaatgtacggcgacatctagtggagacaaatgggtattgcaatccattcacttatcaaactcagtaatggtctataggacccccactaacggtggtaatcctaatactcatattctaacactatattttaaaccatcttgtaaaatttatctcttttcacctagaagcaatcaaactccaaatggtgctagcagaaccacacatggacaggccattcttctgagaacccgtagctcaacctcatgagaaggtccaattgcttttcccccacatgatgccccttttcagcaggaagtagccaggaagaatcatcgtctaacaccccttaacaacagttaggtttacttctcttgaggggggaataataaagttattaaggaataattttaggcagatagagaaggtaaaaggagttatcagtgaggctttttttttttaaaaatagaaacagctcctgaaacatttcttaacagaaaggcggcttgaaaaaaccaggcagacaagtattgatatgcaaatgcaggcgattataaactaggtccatccaatatggcaattcccaccctcatccccatgtcaccaagtgtcatggccgcctccagataactccgcgtgtgcaggacatcttggcggcccacatttgcatattaaaaggctagggtgggaaggccaggtttttcttgggctatgtaaatgacacatctggtcaaaccaatcccctgggccttatgcaaatcagacaccgcctcctccagcctcccaatataaccggctacttttctgctgcacaaggggttttctctctctgcttggagtccccctccatctgtctttgtatgggggagcttcttccttctttcttgcctattaaactctccgctccttaaaaccactccacgtgtgcccctgtcatttatttacatcagcacaagaccaaggaccctgctgttcctccatttcttggagccatgtcaatttaagatattgtactttttaactttaggttttgtatttgattctttttatagaattcctatttattgattgatactttctattcagtgattcactgtcattatactttcctatgatttttaaaacatagtttccttcagttctctgaacatattcataatagatatagtatttacctgctaacatctgtcccactcaaagacatcttctattgtctgttttcttccctgtatatgagtcatacttttcctgtttctttgcatatctcttaactttttgtttaaaaattgacattttacaggaaacaacaggtgctggagaggatgtggagaaataagaacagtttttacactgttggtgggactgtaaactagttcaaccattgtggaagtcagtgtggcaattcctcagggatctagaactagaaataccatttgacccagccatcccattactgggtatatacccaaaggattataaaacatgctgctataaagacacatgcacacgtatgtttattgcagtactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacaccacatgttctcactcgtaggcgggaattgaacaatgagaacacatggacacaggaaggggaacatcatacaccggggcctgtcgtggggtggggggaggggggaggtatagcattaggagatatacctaatgttaaatgacgagttaatgggtgcagcacaccaacgtggcatatgtatacatatgtaacaaacctgcacgttgtgcacatgtaccctaaaagtataataaaaaaaattgacattttagataatataataacttgatattgaactccttctggggctggttgttattgtttatttgtctagtaacttgggtggactaattctgtgcagtctatttcttctgcacagtacagctctagtgtctcctgttcagatttttcttttatttatttttttaattgtaagccttgctgactagcagttgtccctgggtcagcatagcttagtagtcagccgctgattggccagaagttatgcttaaggtctctgagccagtgtgtggtttggagaccgccttcacagcttatgaattagcccctcaatcagccaggaggttgtagctcctagctcgtaagttctcattctagtcatttccaagaatgtgctgactcaggcaggtgccctgtctggtatgagtgtgatttggcagggtcctctttggctatttctatcaccgaactcccttttagatttcaggctgatctgcctctattggtatcacattctgattgttagctgattgctctattgtattaggccattcatgttttgctttaaatacctgagactgggtaacttaaaaagaaaagaggtttaactggcttatggttctgcaggctacacaagcatggtgccggcatctgcttggcttctgggaacgcctcaggaagcttttattcatggtagaaggtgaagcaggagcggttaagcaatatggccagagtagtagcaagaaagagagagtggaaggtgccacacacttttaaacaaccagatctcacatgaactcactcatcaccagggggatgttgctaagccattcctgaaggatacatcgccatgatctaaacaccatccaccaggccccacctccaacattgtggatgacacttcaacatgagatttggtggggacgtatatccaaactatattatctattgtgttcaaaagtgccctggaccctccaagctctgattcaaataacgttaaccccctcaggaaggaccagcaatacttcttggcgtacccccctctccctgggcaaaaccttttcattatggagtggaaggtgggggtgagtgtgtaggctagtgtggctacttggctcccaccacttgcccagtgtagattttccacaagtatgaaagtaaatgcaaatccaaaaagtggagaaaattaaacttttcatggcacaaaaagggaaagagaccccctccatccctttccttagagcatatactttagacgacgtttagttatgaatcctttttctgctccttcaagagatatgtaaatattttttaagctgttaaaaattacaggaagccattgttttggactgagctcctgcactaggttccaacattcaagaaaaaaacaaaatagagtctctcgtgttaaatgccacatcatcaaactaaaactttaacgaagcaaacagattctaaaacagaccagtttttcctgaaaacaggagattctagtctacctgtgtcagcataataataaggaagtatcctctgctttaacccttttaaaaaattaacccaaagtaacctgttgttaacccatccagtttttttctattgttctacttccttgttcccacccttcaatacctactgttctgccatcgcccagtgggagatctcattatttgtagaatggatgcttcccaaattcatgaatcgcagataaaagcaaattagacctataactaaatttgtcgtaattttgtcttttaataaagctagataagccttttgccagctttaaaacacagaaatgtctttctcaagaacctgggtgacatctctttgaaatgtaaatatcaaagaatatagcatccctatctccttgggagtttaatgtaggtgtctggcttcaaattacagccacctatgtgtcatggaattatgagaagttttacaatttctttgggtaaaggcaattagcaaaggcaaatggccacccccaattaccaggtgaatttaaaatgaactatgtgtaacaaacggtgctattaagtcctctcatatgaagactagtctatcttgggaacatgtatgtaataggttgtatctgcctgggctatataaaaagatgatatttctttctatctttccaatctctttagcagattgcttgtgatgcacatcacattctggtttaatgcctattcaataataaaactgttttccttcttttctacttttgtgggcaggttttctgggttggcagattttgtctgtaattatgttttcccaacacaggcacctggagacattgagtactgccaatggactgctgaaccaaacgaagagcttttctgcaacattcatgttgcagaggagatgggaactgccactcagctgctgccactcagctactaaatctgaaatagttattcagcaatacaaaaatggtattgcggggttctggggcagcccctttggctcaaatgccagagctttctgctatacctactgagtttcagtagattttattgaataaaagtttctcaattcattacaagcccttcgatcaatctccaaagactttgtctagtttcaaatatgtttttctaggggaaaggatttgccaagctcctcacactaccattccagaagtcctaaccctgaactatgtttgcaacttcttgtgaatcctaaattattttaaaataaagagtataagaaataaaaatttagtggtgcctagcatgatccaggcagtgtccttgatgctggatttacaaagaccaatgaaacctggttcttttccttcaggatcttatagtcaggtgtgggagacagacgtgtattggaaaagcacagaaaagtgctataggtgctaaattagcaatctgtgcaaatagcatggaggaagggacgaagaaaacaaaagtagttagtaaaatagaaacaggaatgaccaacaaattaaaaagaaaattcaggaaaactatgtccttgtgagtatgaaatcactcacctatacttgacaatgcaactggtcattgggttcacatccttggctcttcccaggtaatagtgaatgatatcccttctcaaaataaaataattcagacaggcttctattcattcaactacgcatccaaacaaataccatttttatgggacttatccatacatcaatcactgtttatcagagaaaccctcagtgaattatctaatgcagttttttttttttttttttttttgagaaggagtctctctctgtcaccaggctggagtgcagtggcgcgatctcagctcactgcaacctctgcctcccgggttcaagcgattctcctgcctcagcctcctgagtagctgggactacaggcgcctgccaccacgcccggctaatttttgtatttttagtagagacggggtttcaccatgttggccaggctggtcttgatctcttgacctcatgatccacccgcctcagcctcccaaagtgctaatgcagttttactgtaagatcagatctgaaggaaaaggagtaacagattgaccaaagttctttatgaagccaagaagtcaggaatagaaacttccaaaaatgggaacatggagtaaagaatataaaaatctcaagtgaagagaatttctaatacagatgtgtcctatgtcaattcattgttcacatatattttccaataagggcaaaactgacacaatgatagcaatactttattgagcaagtagcaaatgtaataattcattcaataaatactgggcactgtgttaggttctggggatacagagatgactcaagctgggcttcaggcctcaaagacttcgtgttctagtggacggacagacagacctgtagatagaaagattctgcctacatgtagaattgcgcctacatgaaattgtgaggagagctatgacagaaataagcatggaggaccttgggaaatagatgagggccccttaatctaggtagccatgaaagaattctcagaggagataatgcttatgaactaggtactattatgatcctcaacattagattagaaaactgcagatcagggaggtaaggtaacttggctgagatcacatggatagtaaatggttgagccagttttcattcatggtaatgtggactcccaaacctcattcgttttacttgactgccaccacttagattttcaatggctctgtttgcttcatatacgtttttgaaatctggtacattttatgatctatgggaaagtcagaaagatactccatatctattggtttaagtacagctcctctgagttctaactactgggccctgatgctgtatagaattctgagcacagcctagacactaaatgtttttcttttctgcagacttgtcagatgccaactgattcacttcaaccttgagtattaattaatttttattttgttacacccacttctaaaggtaattttaacttaaagccctttcaaaatccaatcaaattaacagtataatatggattttcataaagatcccagaatgtcctgctctgaaacaccatccaattgactattcatatcaatgtaaactggacttggagtgttacaaaaatcctgctcaaaagcatatactaaaccattaccattttcttgtaagtacaaatcagtttttatgagacacagtcttgctttgtcaccaaggctggagcgcagtggtgtgaccacagctcactgcagcctcgacctacagagctcaagtgatccttccacctcagcctcccaggtagctgggactataggcatgcaccaacactccaggctaattttttatttttgtagggataagagtctcactatgttgcccaggctggtctcgaactcctgggttcaagcaatcctcctgccccagcttcccaaagtgctgggattacaagtgtaagccaccacacccagccaaggtttttgtggaagacagtgtggcgattcctcaaggatctagaactagaaataccatttgacccagctatcccattactgggtatatacccaaaggattataaatcatgctgctataaagacacatgcacacacgtttattgcggcactactcacaatagcaaagacttggaaccaacccaaatgtccatcagtgatagactgaattaagaaaatgtggcacctatacaccttggaatactatgcagccataaaaaaggatgagttcatgtcctttgtagggacatggatgaagctggaaaccatcattctcagcaaactatcacaaggacgaaaagccaaacactgcatgttctcactcataggtgggaattgaacaatgagaacacttggacataggaaggggaacatcacacactggggcctgtcatggggtggggggaggggggagggatagcattaggagatatacctaatgtaaatgacgagttaatgggtgcagcacaccaacatggcacatgtgtacatatgtaacaaacctgcacgttgtgtacatgtaccctagaacttaaagtataataataaaaaaataaaaataataaaaagaccaattataaacatgccccacataagactccaaaaagttctggacttcatggcccagaaatagtagtatcctgaatgaaaacaaacaaacgaataagccaaaaaccaaaaaaactaaaactaaaacctttcctcctcctctttttgttgcctctacactagtactgaccatagtgagacacactgtgtgcgtgtgtgcgtgtgtgtgtgtgtgtgtatatcaccgaatggtatattttcaaccatttttgacctttgtttgtggaaaagctgcttaacctctctgattcttggtttccccattttacagaataggacaactacttctcagagtcagcgtgaggattagatgtcataatacatgtagacatgtttttgagaactacaaagggctgtatatgtgttatatactcccctgggaacatttggagcacacagaaattttggtgagtcacagaaaaagcaatttttataaaagcagcttctccagcccaatcccttgtatacaacagtgagtgtttaatatattttattataccaatgagtttatgcaaacttaacccattcggaagtcataataaatgatgcttgacaccacactaggaacttgagattcaaatggataaaacagggttctttccttcaaagaactcatggtctagtaggggaaccctggaaacaaataactacaaggattgtggcaggctacacagtagaagtatataccaggtacagtgtggtacacaggtaggataggcactcccaagtctttttaccctttcaggctcttgttccattgatcaccacatcttcctatgtctccatcctcttcctgtctactggctcctccccataatcaaataagccatgtcaccctcttggtcacaatcacagtttagtgagtgagtcagataagtactttaggcaactgcaggattcacagtggattttcatcttaaagttaaacaggaaggtatggcaatagagtattgatatagtgagatgtgtctttagttactgccatgttctgagtaacttggtgaatgacaattcaccaaggaccccaggaggagggaaagtattaggagtgggaggctttgcaaggtcacaggttcagatttagatgaataaataattacaatgtttaatgcttcatacttggcatgaaatgggacaagataattgtggaataagaaaactaagttaaaatcctggctctgttgtacatgagctctatgaccttgggaaattttctatgtgttgaagagtccattcacccaacattattgataagattaaaaaacaacagtaaaatttataacatagcacaatggttgagaacacagcctctggagttggattgcttggatttgaaacagtgctaccctttatttgctgtaggagagtgaggaaattttagcttcttagttttcttatctataaaatggcatattaaatagtagttctgacctcacggggcttttatgacaattcagttgcttaatatattaaatagtagagtagagtacctggtatatagcaactgctaaatgtttgctaaatatattaggaatacctatttcagagttcactgcaaatttcacaagatatgaaaattgttaattagttgtaactatgccactatagtctcttccaaaatcctgattttggaagccatggcatgtcgtctagcttcgaattatctttaaagtgaaactgcactgttgaatcctacagctccttgaagtacttgtctgactctccaactaaacagtgacagtagcagagatggtagcacggcctaattggaacagctaatctttaggtatctgatcattcaatgtagtcctcaacaagggtcagtcagtttcctgcagccaggggagtgcagcagaagcttcagagcactggaaccacagattgtcctgttgaggatgtggccccgacactgaaagtcatgataagacctaatagctccaagtttgttctcctttccttcaggacttctccctatatacccccatcgacattgctctccatctcattgcccattggcatcagacacatacacataccattcactggcaattaggactaatcatgagacaaactttgaatatgtggattgtgagcttctttaagtaagaagagtataaaatccaaataaacatattcaaagagaggtgtgcttttggaatggaagcagtcaagttttgtttagtttggcattgagctgtaagaaacagggtcatgttaaatagagcttctatgggtctgtagccatttatcaccacacagatgttttccagccccactcctcacctgctgtcctcttgctgtttcctcagtcagcaatttcctattctccacagagctacgtcaatactgccctcactttctcttaacctcttatattactcacactttctcacctcatactcactagataactctattacctctccaagggaaatgaatatctcaggtgtaacataccttagtttcataatacaaatctaccaaccttccttatacctatccagttttttctccttccctcctggtacagtggaaggggtaattttctaccatctaagataaattgcttcactgtgcttcacatcccaagtccttccaccctctcaggctctttttccactgattactacatcttcctataccttcaaggctttccctctgtaagggttcctccccattaacaaataaaggtgcccaagtctctgacacctagaaaaccttaaaactctccttcaatgtgacctttctctttagctaccatcctatttcttgcctctccttcaatagttaattaaattatttgaaagaattatttactcattaaatccagatccttatgtcccacttattcctcagcccactgccatctgctttaccactctgccactctattgagacagttttcatcaatgatattttctgccaccaccactataatactccatattcttcacaactccctccttaaaatattgtatatcctcaattctctttattttgaggactgcttttgataactcctttgtatgcaattctccctctgctcatcacagaaatgttttttgttaacagctttattaaggtataattacatctgaacttgcttctagacacaggtaaattaaaaaaaaatatatatatatatatagttacataccataaacttcaccagtttaatgtgtacaattcaatggctgttagagtatttacaaagttgtgcaaacatcatcataatctaattttgaacatgttcatcatcaccaaaagaaatcttgtacccattagaagtcaatcctcattcccctttcccctagccataggcaagcattactctactttctgatgctctagatctgcctatattaggtattacatataaaacaagtattacacagtatgtaatgtactgtgtctggcttctttcacttagcataatgttttcaatgttcacccatgttatagcatctatcagtatttcattcctttttattgctaaataatatcccattgtatgggtatactacattttctttatatagtcatagtctatggacatttgaattgtttccacttttggctatagtgaataacgctgctatgattattcatatacatgcctttttgtgaaacattttcatttctcttgggtggatacctcacagtagaattgttgggtcatatggtaagcttgcttaacattctaaaggactgccaaactattttccaaagtggtagcgatatcttatattctccccagtaatgtatgaggactcaggcttctccacatccttactaagtcttacttttagtctttttgattataggcattctagtgggtgataagtggtttctcgttgtggttttaatttgtatttccccagtaactaatcttttattattagttaagcatcttttcaagcgcctattgtccacttacatatttccttggaggaatctattcaaatcccttacgtagcttttaatcacattatttgccttattattgatttttaagcattttttaatattctggatacaatccaagttgctgatcattttaaagggcgaacttttaatgttgttaattttctctattgttcttctattctctatttattttcatttgaatatttagtattcctatcctgcttatcttgttttgtttgctctttttttgtggagatttaaatgaattacccagtaagtactgctttagctgcttcttgctttggtgttttgattacatccatctcgaaatattctttaatttccactgtgacttcttatttgacccacaggaatgtgttgtttaatttctacatatttgtgagtttcacatgtttctttctgtcattgatttctaaattccactttggttagagaatataatttgtatgatttcagtatttttaaatctattgatgcatgtttatggcctagcatatgatctattttgcagaaagttacatgtacttgaaggggatatatattttattgctgttgggtggagtggtctttagatgtctcttagtttaaactgttttatagtgttgttcccttgttgctactagtagcatggaaccaccaagcccctcttaattgctcaccattaagatactcactgttttcaacaatgctttcaggcattaacttctccagattttgttccccataaattcagtcccttcaggcagagatgctatgctttatgccctgcctttctacatatatagaaactctggacaagtgtacctgagctgggtgtgggtatagtagaccacttctccagtaacaccttactctattagtggacactgaggagagatggtagcctctggtcatttcagcttgccagtctccatgtagaaactttaccttacaaatacactggcacataggagattgggaacccactagtcttagcctatcacagctgaggcagaggcctcaccctacaagtaggagctagtcctctagcccagacttgcctgcctcgactaggacttctgcaaaatggcgctgtggagggataagacactggtggctttctcctcctgggtcaaactatggactaggaacttgggggatagaggcccccatcttcttggtcatatccacatgtagcacatgtagtagaggtctagagtagagcttgtcacatggggctgggggagatagaacagcttgtagctcaaatgtcacagattctaaccatttttgccaagatttagtaattttcttaaatacttcttcatttgttatatgcccttatgacaatttctaaagactttgtgtgtgtgcatgtgcatgcatgtgtgcgtatatacatagctgtcacgaaataatggtgtttctctgggaaatgggttcaccaagatcctcatataactataacaaaaatgcaggttcagacactgccatttgcagagtccaattaacaagagcaaggtctggtataaagaaagtgactttttattccaaagctagcttaggggaagaaatacaggcttcctgccatagaggtacaaattcacttttggagcagaaaattgacacttttaaaaagggacccagcatgaatggcacgcaggggaggaagcaaacaggtaggggtctgcatgctcactttggtgccttatctaccaggcagtgaactggtgcctttgtgagcagaacgagattgtaaaggtggccgaaactttccaggtgggagagagtgtcatagcaggcatactaagggttgtaaattgactgttgtccctcaaggcagtctcctggtgggagagaattctgctctggagcttctaagaacatggttagatgaacttgccctgtagggagcgtctgatgtaggggagataaaaggttataactgcatttctaaagggctacgtaagaagtggggaatggggaaattgataaaataagagaaaataataataataactcattttctttttcttagaaatatgagtatactcaattataatttcccactgtcaggttccgttttacttctatgggatttgggtgccacattcactctggctacttcctgctgagaaagggcatagtcattgtttgtcaaaatgaaactgatctacttggagttggaaatattcacaagtacccagacttacagatgatgtttgttggaacattacggtgtgaagtttgaagagtctttgggaaagcctgtcttgcatttccatacagagtgtgcaactgcagtaaactccacaacagaggaatatgcctatccctgcaatcaaggccaatgttacaagcagctttttctaccaagatggtcttgacctgaaccagaatactgaccactggtctattgacaatattatgtcagacataggtttgagttgttggtgcatgtcttgcaaagctagagacatttttcccaaattatcagggatgtatatacagcagctactcttaattatcattcaggttccccactgccaattgtaactggatataatgacaggatggctaaatatgtatttaaaaggttacaggaagagttatgaacactcatgaaggtggccataagccctgtctagtccatgagaatggattagtttagttaaatagctgtgttctatccaggaggtagcactgcagatgggctaggcctctgtatgtgatgaaggcaaacagatttttgataagaggcatgtctatggaaacagaagaaaaataaaggttaatgttgggcacaattttccagatgttagactcacagcatctttagttacagaggaggaaagttgtggcagcctgacatgtttttcttgcctgtgttacaaggaacaatgtagtagcgatttcattgagttcggatcaggaaaatggaagaaaaaattcaaagtgtttgtttagggacttgtagcccagaaagaattcagaatttagtccaaattgcagaaaataataaaaactcaaaaacaatggacaagactagaatctaacacaggtgtactatagttttttctgaaacataatttttctctctccagtccccatttttactaaagacaaatcatagtaggataaatttatttggaaaataaggtttagtcttattttgcttgtcctaattatttgcatcaagtacagcaagaataattatttgccatataagttcctttgcaacttggctttgctggaatttttatttatacggaatcttggattaaaccttttaaagcttcgagcccagccacagatttattggtgcctgcaaataactgcatggattgagtgaatccctttccttttgaagtcccaaggtaacctggggctcctgagcctgtcaaaaagtgaccttctttacttagcacaagtcaggaaaccctgtacagggactgcatggacaaggtatcaggccagtttttcccaaggggctttaattggctctataagtcaactttgatttgttgaagccatctgttcatatctgaaagtatggcaatccagttaaagccttgctaaaataaccagtgtctccagtggtgtcctgttacaaaagagaacagaatcttattgagtttatgtaaaaataactatactgctataaactaagtatacttacaaatagttttcaagttctggagaaatcaggtagagagaaatatgctccatatttttctcacacgagtgtactttacccaattgttaaaagctgtaaatagctcaaaagaaaaaaaggtttctggactctgagaaacaaaagaattagcaatgcttcaaacaaaaagtcataaaaagattagtcttccattagttcagtctatgcaattaactcccgttctgctcaatattccagaacatattagctccctatgggagtcttggaagttttttttgtccattcgagtgtcacaatccccaaagttaatagaaacctgcattcaagaatacctgtcagaatcctacagctgattataaaatggcctttgaagagaatcaaaataaaataacaattatggatgatagaagtctcagaacactcacagataaagacacaattgacaaggaaatctggtcatctctgtggcatgcaataatttaacatagcaatcttaattattactgataacatatattgagatatatcagaattatggggatcttatacaattctggaaaacataccaataacatatttacatgaatataacccaaagaaagaaagttaaacaccattttatatgtaacagtgcttcctgtatggctttaatataccaagtaagccaaatatatctcttttggacttcaggggacctaataaaagagttaaccaggtcaaaaaaaagcttaatttagaacttgactttggaaagtttatctaatatcaaagctttaaacacctgatattacaaaatagattcccaggtcactataagctatttatttaaccaagataactcaaaagttttttaaaggctaaaatctttactcattgatagagggcagactcagctttccaaacaaaacccaaaaagacagcatgaggacaactgaatctcttttctctcccttcttttttctatcattattcaaaaggcaaataaaaatctttcattatcttttaatatcacacgaaaatcctgttcaaaagagaaagccaaatttcacctttgcatttagtgtgctattaatgttaaacccaattcttaataaaaccttataaacaaatctgtccaatcttaattagtttgaccataatgtaaaatttccataagcctttcataacactttacaattttctgttaaagagcagatcaatactctaagaagaccttgtaattccaacacatgggcccagattctggccctgcatcagtgtgctttttttttaatgtttaatttttggaaaaactaaatagcctccttcaaattttagccaacttgctcatacccacggaacttcctttacaagatcaatctctcacaaatcttttacaacttgcttaagctctcagttttgtcctattattcttttagcttaggacaatccttaaaaacctctgaactagacaaaattgcatttcctttaacaaaaaccataattacatgccttcttataaccttttactaaaaatacattctaccttccttatacaccttgcacataaagctgtttcttcagtagtctcagttacttgttacaatgttaactctcagcaacttttatttttggtgaaaaacgcggtaagtaagcaattttaaccatgtatcaatcagattatggagccaaggacaaagacagagctgcagacaatgtctgactcttcccagcctagccagggaaactggctaactctatgtccccaggccttaactagagaatctaattggctgtaaacagacaagttaagtaattattaaaagtcatagaagcagcttatgaccttaaggcatctagaaaacagtatctgacctgcctaatttagaccaaacgtctaaacgttgaagacagttttcttttatcaataacctttaaaactaggcttatttaccaaagattactacagtcttgtgaactaaaaggcattacagtttttatttttctagaaaagtatttgatttaagcacttatttttaagccaattaattagagctcttttatataagcattacacatacaacacatatacatacacagacagaagcagatctggtagggagataaaatattagatacaagaggaagaaggattagacaggagtaaatgaagaatcagacagaattccattgactgagaagattttagagggcaagcaagggttttaaaacaatataggtacacatataacccaaatatcacctttaagttaatttctaactacaaagctctcaaaacatatgtatatatatttaaatcttttattaccagatttcagctaggacaaagggccaatatttctgacttttaattttttttaaataaaggtaacctcctacatgaaatcaataagccttaaccaagggtatgacttaactaaccttaggtgcatggggcattttcgaaaagatggcaagtgattttcaaaagctcagggaaagggaaatttcaagacaggaaatcagaagctgtccataaagggaaaaagaatcaataaatggccaaaagtcacacaaataacaaaccagaatggacctattccctaagcacctaggctgtcactgtgaaaggcaaagcctactgagctatgggatgggccacatgccactgacctttccagaaggacctagagcaatcatttatgagcttgcaaaggattttagcttctcacaagaattaaggctagacatgacattatcatgtaccctttttagacccaagagtcaaagctctgtcttaacagcacaaggacttaaaaagcaatacagaaagttacatgtataatctcttcaactccataatttgaattaacttttagataacttttgaattagtcaaaattatttttctcagtaatgagaggtgaagccagctggacttcctgggtcaagtggggacttggagaacttttctgtctagctaaaggtttgtgaatgcaccaatcagcactctgtaaaaacacaccaatcagcactctgtatctagctaaaggtttgtaaatgcaccaatcagcactctgtagaaacacaccaatcagcgctctgtgtctagctaaaggtttgtaaacacaccagtcagcactctgtaaaaatgcaccaatcagtgctctgtgtctaaaggtttgtaaatgcaccaatcagtacctgtaaaaatgcaccaatcagtgctctgtgtctagctaaaggtttgtaaacgcaccaatcagcactctgtaaaaacggaccaatcagcgctctgtaaaatggaccaatcagcaggtcgtggacggggccaaataagagaataaaagctggccacccgagccagcagcggcaacctgcttgggttcccttccatgctgtggaagctttgttctttcgctcttcacaacaaatcttgctgctgctcactctttgggtccgcacttcctttatgagctgtaacactcaccacaaaggtctgcagctacactcctgaagccagcaagaccacgaatccaccgggaggaacaaacaactccggacgcaccacttttaagagctgttaacactcactgcgaaggtctgcggcctcactcctgaagtcagcaagactacgaacccaccagaaggaagaaactccagacacatctgaacaccagaaggaacaaactccaggcacaccatctttaagaactgtaacactcaccgcgagggtccgcggcttcattcttggaagtcagcgagaccaagaacccaccggaaggaaccaattccagacacattttggcgacccagatgggactatcaactatcaccaagcagtgagtaccatcggacccctttcacttgctattctgtcctattttaccttagaattcgagggctaaagaccaggcacctgtcggccagttaaaagcgactagcatggccaccggactaaagacacaggtgtcagggtttctgggaaagggttctctaacaatccctgactctttggagttgggagcattggtttgcctggaaccagcttccacttttcctgtactgctgggctgagccaagggtcgacagaagaggaaagccattcagctccggggtcccaacaacaagttggttcaccctgtggccatgagcagaactctcaaagtcatgtcgcccaagtgagactcgcccatctatcctatctatcctgacccttgcctcctgggtcctaatgcttgtcagacaaacttcatctcacctctcttctccgaggctagtcccgcttctaaaaaccactccctgtgtctggtgcttttctagtttctcctgtaagaatgatttctagtataaactccaggactctgttaccttctttaggcacccaggctcaccaattagaaagacataatttttgcccaaagccccgtcggagcgggggactatcttatctggaattttaggatccctcctcagactagcaggcctaacaaaagctattcctgaagctaagatatggggagcctcagaaattgtatccttcctattcatataaatgaggacaagggctgatgcaagcctttgtcctcttccaactctggagatccctcccatccctcaggatatggccctccacttcatttttgggacataacatctttataggatggggtaaagtcccaatactaacaggagaatgcttaggactctaacaggttttcgagaatgcgtcgataagggccactaaatctgatatttctcggtcctctttgtggtctagcaggacaggcaagggtgcaggttttcgagaatgcatcggtaagggccactaaatccgaccttccttggtcctccttgtggtctaagaggaaaactagtgtttctgctgctgcgtcagtgagcacaactattctgatcagcagagtccagggaccactgtgggttcttgggaaagaggtgtttctgctgctgcatcggtgagcgcaactattcccatcagtagggtccagggactgttgcgggttcttgggcagggggagaaacaaacaaaccaaaaccgggggtggttttgtctttcagatgggaaacactcaggcatcaacaggctcacccttgaaatgcatcctaagccattgggaccaatttgacccgcaaaccctgaaaaagaggcagctaatttttttctgcactatggcctggtcccaatattctctctctgatggggaaaaatggccacctgagggaagtacaaattacaatactatcctgcagcttgaccttttctgtaagagggaaggcaaatggagtgaacttatgtccaagctttcttttcattgaaggagaatgcacaactatgcaaagcttgcaatttacatcccacaggaggacctctcagcttacccccatatcctagcctccctgtagctccccttcctattaatgagcctcctctaatctcccctgcccagaaggaaagaagcaaagaaatctccaaaggaccacaaacacccccaggctatcggttatgtccccttcaagctatagggggaggggaatttggcccaacccaggtacatgtccccttgtccctctctgatttaaagcagatcaaggcagacctggggaagctttcagatgatcctgataggtatacagatgtcctacagggtctagggcaaacctttgatctcacttggagagatgtcatgctattgttagatcaaaccctggcctttaatgaaaagaatgtggctttagctgcagcctgggagtttggagatacctggtatcttagtcaagtaaatgatagaatgacagccgaagaaagggacaaattgcctaccagtcagcaagccgtccccagtatggatccccactgggacctcgactcagatcatggggactggggtaataaacatctgctgacttgtgttctagaaggactaaggagaattaggaaaaagcccaagaattattcaatgatgtccaccataactcagggaaaggaagaaaatcctctgccttcctcaagtggctactggaggccttaagaaaatatactcctctgtcacccaactcacttgagggtcaattgttcctaaaggataagtttattacccaatcagccgtggatatcaggagaaagctccaaaagtgagccctgggccctgaacaaaatctggaggcattattaaacctggcaaccttggtgttctataatagggaccaacaggaacaggcccaaaaggaaaagcgagatcagagaaaggccgcagccttagtcacggccctcagacaaacaaaccttggtggttcagagaggacagaaaatggagcaggccaattgcccggtagggcttgttatcagtgtggtttacaaggacactttaaaaaagattgtcctatgagaaacaagtttccccctcacccatgtccactatgctgaggcaatcactggacggcacactgccccagaggacaaaggttctctgagacagaagcccccaaccagatgatccaacaacaggactgagggtgcccggggtaggcaccagctcagctcatatcatcgctctcactgagccccgggtatgtataaccgttgagggccaggaaattgacttcctcctggacactggtgtggctttctcagtgttaatctcctgtcctggacaactgtccttaaggtccgttaccactgaggaatcccgggacagcctgtaaccaagtatttctcccacctcctcagttgtaattgggagactttgctcttttcacatgcctttcttgttatgcctggatgtcccacacccttattagggagggatatattagccaaagctggagctattatctacatgaatatggggaacaagttacccatttgttgtcccctgcttgaggagggaatcaaccctgaagtctgggcattggaaggaacaaactccggacacaccatctttaagaactgtaacactcaccgcgagggtccacagcttcattcttgaagttagcgagaccaagaacccaccggaaggaaacaattctggacacaataagagcccatgttctttggtacattttatataaacctaggaagcaagaagtcctgaactgtgtatcgatattagcagtttatagatgagaacattccacaatttttggaacatgtttcccacacagcaacccctttttaattggaaatgacccagacatccaataagcatccaaaacaattctaagattttaaagtatacataagtctacttacaagcatttatgtcatttatatgtacccaattttcccatttctaacagtttatttagattacttctgaaaattgagatattacacaaaggtggtcattatttaaagttatttccctgttaaccattttaaagcctgtaaacattaggtgtttaagtaagaaccttaaacatatgggcattttgtcaataactcagatttagaagttaccactgaactaaaattagtctctgtcaaaaaaaatatacaaactcaccactttatggtgaaattcacactgctaagctattctttcatgagattggaacttgtttacatggctaaattttgtttgccccaatacataatccagtaaaagctgtgaacttaaattttggtaaagcactccctgtggtggcttttttttaaaaagaaacattttacccttttccccttcagtttcaagtgagtttccaatgtttacgttctagttagtccacaaataatgagtcctatctcagtaccagcagcttagtaacagcagatttaaagcaggcagaaaagaagagaaagatatagcctggcaggcctccacacagaagccaggttttacaagtggggcatgagaaagaaaggaggggaagaaggttttacgagtggggaatgagaaagaaaggaggtaaagtgactgaaaggaaacttgggagccttccagccatcacacagtgcagggtcactacccccaccattctcatttatcttccattaaagagagcctcagtaccccaagtgggaggctctcccagatagtcagaagggtgaaactggaggtagagagtaaagtgatcagggcccatacacaaagtcatacatttacacatggaaacaaacagcatgcttccgaatgaatcaccaatcaagggattgggtgaggtcctgaatcccccgccccagttccaaatggctccacaggcagctgagtccaagcccagcaaatggtcctttggtgttgcacatacaaacaaatgtaaatgtataaaatgatgaaatggtgtcactatcagccaagtctaaataaagcagggccccgcagcaccccaagagaggcagaaggtggtcaggtgcactctaactcactcactcaattccagagtttgctggcttcttcagaggtcactttctttgtacccgtgaaggattgaaagcagcagacatcatgctgggaggtgaaagggaggttcaccaagaacaaaagcctttctggcagctgctgtgaagttccctaatggtcctgtcacgggtctgctagccaagagcagctggcactcacaggcgaccccacgcctgacccagtgatgaaaccaggctgacaggcttggatcgcctagggcacacagaacttccccatatgggccaccaaaactgtaaccaaaatgcaggttcagttgcttgccacttgcatagtccaattaacaagagcgaggtctggtataaagaaagtgaccttttattcaaaacctagcttaggggaagaagtacagacttccttccttaaaagcaccgcttcacttttggagcagaaagtgcatgcttttaaaagggggcctagaataaatggcatgcaggggaggaagcaaacaggtgggtgtctgcgtgctcactttgttgcttcatctaccaggcagtcgagttggcttcttcatggacagaactaggttgtaaaggtggttgaagctctccaggcgggagagttttgtagcaggcatactttgggctgtaaattgactgttgtccttttggcagtctccttgtgggagagagttccacactggagcttctaagcacatagttagatgaaattgccttgtaggaagtgtctagtgaagtggaggtaaaaggttataattgaatttctaaagggctaagcaggaagtggggaacagggagaaaaggaaaaaacagaaaaggagtaaccaaaataaaaaataataactcattctctttttcttagaaatatgaaatactcagttacataaccatctggaagtccttaaatgttgatactactcaaagagatcttcactgtcctctctctacactctctactggatgatctcatttatatcctcttcacctactgcccatgcactgatgactccaaaatctacatctccggctcattcttctttcctaggctgcacatcagggtatctccggccttttgaacatctccaagttaatgccccttgggtaccagaaattcacatttataaaattaacctcacattcttctcaggcctgcatagggggaagaagtacaggattcctgacttaaaagtaccgcttcacttttggagcagaaagtaggtgcttttatatttttcctctattaggttccatctaagggaatggcacaccatcaactcagttgctccagccaaatattctaaaaatatatccatgatatccacacctctctctcaactccaacatccaattaatcaacttatactcctttaaatgccacatatttacatcttttttttttgagacaaagccttgcttggtcaccaaaactagagtgcagtgacacaatcatagctcactgcagcctcaaactcctgggcttaagcaatcctcctgcctcagcctcccaaattgttgggattacaggcatgagccactgtgcctggctcacatatttcttgaatgtatctacttctttcaacatagtcaataccctagttcaggtcaccatcatttctcacccggactattaccacagcctcttcttagccctttagcaaacaattttctactcttcggattgaggtcatgtctcctttcctcaaatccctgaacaagtcacatcagactctctataatctagatttttcttaccccatcagtttcatctccagaagatcctttcttttcttttatacccttacactacattctagacataatgaacaagttcttgttccccgaagcaccatattttatctgtcttccagaacctcacatttattcttccttctctgtggaataccctttcactacttttactggctaaatcctatttatcctttagatgtcaaattacatggcatttcctccaagaaactttttctcttcttcctagcctcatatagattagttccctgtactatgagctagcagagccgactgaatccccactatcataaaaaatacttagtacattttgttggaatgtataatgtctcctcaatacactgagagttccataaagacaggagctatttctgatttgctcaacccacataccctgaggtagcagaattcttggcctaaagttctgaatagctttatcacagctaaagcacagttgtaaggatggaggcactagatcagtgcaaatacttgactatttatctaccaggttaaacctagatggaaaaatacagcttaaataactcaaaattttactgattgaaacatgatgaaggccccttcttcatatattaagtactaagatttaattcagaattagaaaaaggtcaatgtaaatagtcttggacagcaagtgtttctgggaaaggtttccttgctctaaatcaaatgtaatagtaaacttttaaaaatagattttgtgtatatttaaggtatacatgttatgggatacatatagatagtgaaacagctactataatgaagcaaatcaacatatacatcatctcacagagttgcgctttcttttctgtttttgtggcaagagcagcattttttttttttttttttgagacagagtcttcatctgtcgcccaggctggagtgccttggctcactgcaagctccgcctcccgggttcacgccattctcctgcctcagcctccagagtagctgggactacaggcgcctgccaccacgcccggctaattttttctatttttagtagagacggggtttcaccgtgttagccaggatggtctcgatctcgtgacctcgtgatccgtcctcctcggcctcccaaagtgctgggattacaggcgtgagtgaccgcgttcgcccaagagcagccatttttaatggcagaatggcaacagcattctgcatacctggttatctaatcccaactttgttctgtattggaagcgtgacctgtatcattttacctaaccttgctgagactcaattttctcatctgaaatggagctaacagaacctcccctgcccccatgtgactttgagctcaaataatttatgtgaaaatagtgtaataaatttttctttaaaaatacattaggactgagctaactccttaaatgtccactagggtgcatcatgccaccactggaaccatctgctaagaatgactttgcagtctacctacatagtcttcttttaacacccaagaaatgaggtctaagtttgagtgagtagataaaagaaaaataattgttaccaactctgccctgagccctctatcccctcagcactagccccaaagtctaaactcccagaggtcttggcctgcttcttcacattgctgtgaagacttacacaggtcacagtgttaatggatcttcttggaccgtggatgggctttttggttctccatgtttaccatccggtataaaggaggaccactgaattcattataagctgttgtcatcatcttcatctaaagaacatgagcttttgagtaagataaaactgaatttccattcccaacccaccacattccagtcttttgattcatttcactgatttcaggtttatagccttaattctgggaatagaaatttgagacatctcaagtgctatttggagactgagttgagggaacaactttcccctctcctcaggtatgggaatatcagtgtccataatttgaaattgcagactctcagtttttggtagtggtaggggttggaggatggagggatttctctaggccatttggagtcagcgtgggtcagaggactagtctagcaacaaaacctacaaagtgtctgacccttcaagtatacactgtgcagtagttgtaaattgtattttttgtattacatttccctcacattatctggtaatcttcagtaaaatctcattaaaagtcacggcctagtctctgatggtgctgtaagaaattagggaagggtgtgggcacattatggggtaagaaggtagaagagggagagcaggattcccttttgagtccagagttatttaccacttggataccactgtgcccagaggagcagcaacttcatgagggtcagagcctgcagagaggcagtgatatggtggcttgctgagaagccagagaagacaaagacaactttctggaaaacaggtaaactaataaaaggcctacttttagccaatacactgcaattgtatgatttattacaagagcaccccctctgaattgatggcttgtccccagcctcagtgcttggtaagtaaaaagtctgtgtgggaattaggaaacaaaagcaaacacaaaacaggcctattccaccctgcactaagtcttggtgactagagcttggtctaaatttcagacccaagttttctgctatgctttttatacttatgcaaggcagaagcagtacaaattccattatggccctgcgcattagcctaaaaaattctaaggaatagcgagatgcctgtatggcatatacttaacaataaaaagatcatggattatttggaaatattctggatgaggcacacctgtgctatccttgtttgaattatatatatttgtaaatagaaagactggaaattatatatatttaaacttggttatctgtgtagaggaatcgtgtgatttttttacatgtaattatttaaatttttatttttaatttttttgagtacatagtaggtatatatatgtatggggtatatgggatattgataaaggcatacaatgtgtaataatcacatcaggataaaaggtgcatccatcaccacaagcatttatcctgtgttacatgcaatccaattatacttttagtcattttttaacgtacaatgaaattattgaccatagtcaccctgttgtgctatcaaatactagatcttattcattttttatttattattttggaattttaaaaattttctgaaattgagatgaattaattttgtagtcagaaaaaacaaattcagtgcccttttttaaaaaggtaaatagtagaatgagtgtcccaactggaacctaaacttatgtccaccactagggtttaaagttttccggtaatgtgtgacatactgaaggggataaagtcctttggcatgtagaactgggggctttgcaaggaaaaattcacactaacggaagagcagtctgcaaacaagtttagctcaagaacaaaagctaggttttcggagaggaggaatcaatctttctgggctgtggatctgtcttctgatcagccttctgcacttaagtctaggagagagggggcctacaagtaaactctgaagaatacttttttcaatttttattatggaaaatttcaaacatatacaaaagtatagagaatagtataatgaactctcaaacatccatcacacagcttcagcaattaccaatttatggccaatcttgtttcatctatgtactcaattaccccacactcagatgattttgaagcgaataccagtaacatatcatttcacctgtacatttttcagtatacttctctaaaagataatcattttttaaaacaacataaccacagtaccatatcacatcttaaaaaacaataaatcaagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatggcaaactccgtaagatttcttctaaacatctttgttattttcttaaaattgttctggaggcagctgatgcaagtcctcttttttaaaaaaaccttcactttgtgttcccctctaatagcagcctctttcctaaatgccttttctaaatgacaacaattttgccctctctcagccctctgcattctcatatgcagaaaccaggtaggatgaggagctagctgtgtgtactggaaaagggatgaaaactacagccaaatggatcagtgagagaggcaaaagaaatctagacaaactaaatggcataattaagtttggaaactgcctatgatatagcctgttggctctggcatcaaataatacagtatgttaaatctgtaaaatgaggaaacagtgtttcctcaaagagatgttaagatgacatgtaagaagtggttagggcaggcattgcaaaaaaatgtcttatatatcattttaaaatttatttttataaaaactcacaacattattttgcgtccactgtatttatttttacaattacctttatagcaagtgatagtttttgaataaaatttaagcaaatcatcaacagtacaaaaacactagagttgttacacgaaggactgattctacaaaacattaccctaggtgatggcataatcttaaaactgtgcagctactgtgtggtatgacatagaaataggagtaataattcttgtcctcaaacatcttacaactgtcttgaaatatttctgaaacacctgatacacaaaagccacacacatggtgcctagatagcatatactctactagcaccagattggaaggggaatgttttgccacacggtgattacaaaatattaattgaatcaaagaaccttcagtgatgccaaccatatttcaagtagtgtctcagatgcagaatatgcaaagagtaaggaaaaatagtctttgctctcaaagacatcatagtctaatgaaggcagacacatcaaaaaagcacaacaaaaggctataggtgctgaattaagagtctattcacgtataagagtacaacaaccagagcaagagtcagtggtatagacagggaaggagtgtcccaagatgcaggaagaaaccagatgagctgtcttcttgggaacacagaagtgctcacctgtacttgacaattccactgatcactgggttcacatcaatgtttctttcagcacaatactgaacatctttgctgttcatctggaaaaacaaaccaacacacaattagcaggcttatgttaataattcctccaactgacaaatgtaccaagagcttattatgtacatcaatcactttgcatcaagcacttcacttccacagaattatctaatgcagatgcaatcaatgagtctggatcagcaactgaggggttataagccaatgtataccatgatgtaaaaaagtcaggaaagcagcgatatcagaagttttgtaaaagaggagtgaccatttaagacataaaatatcctaaattccatgttacagactctagactcatggaaataattcaggctgattcccacccacgaaagagttttcagtccagtgaccacatggccaagaaaacagattaagtacaataaactctgcgaaccatgacacagaagagggtttcttaacccaggtggtcaggaaaggcttctcattggagatgtttgtaaagtgtctatttttactatctccaacaacagattttttttttaaactgagcgtcagatagttagataacttggcttaagtttcagtgaggaagaactggaactagatctgtctgacttcaaacccccaatgtagtttctatcacatcatgcgctcactctttttttttttttttgagacgtagtctcactctgtcgcccaggctggagtgatcttggctcactgcaacctctgcctcctggtttcacgagattgtcctgcttcaacctcccaaatagaaggtattacaggcacgtgccaccatgcctggctgatttttgtagttttacttcattaataattagaagtagagttggggtttcgccatattggccaggctggtctccaactcctgacctcaagtgatctgcccacctcgacctcccaaagtactgggattacaggtgtgagccaccatgcccagcccatgctctcttattcttataaaagtgttatgttttagcacagtcagcatagtaacttccacttcttatagtgctgtttgcccaaacatatttaaaatctgctaaataccattagtattaatagctatcttatcaagagaccactaccaggaaaatattgtttaaagtctttcagagagtacctggtggctcccccacaagggaattctagaggtgaaagctctgccaggcaaatacacattttctaactgtaaacaaattggcattcttatactaaccttctgaaatgaaatcacagaaagaatttaaaacctttacatcaattgttgcaaatgaatctatgcaaataaagcaacaaaattattttcgagtttcttccctttagtttgtttctttaaagtgtagtcaacagattttgtatctaaacacacacatacttcttgagaaaaactgtatatattatagacacagcaccaattgtttccagtatatgcatctatattaatgtttcctctttatatattcacaagaataaaacacttgaccagctgaaaatgtaagctatttataaaacatgcagaaaataaatctgattcatgtctgcaaacctcaattgtctgtgtactctttttcctttctttatcaagacagggctgtaaaatttaggtgtacatttttctgctatcacaaaagaaataatgtacaagtgaactctactactcttagaaggaaaaaaatctcaactatacatcaaattttggagcactgaagtggcagaaattttctatatactacctctgttctaaagaaatgtggtgccactgttccgaaaacaaatcttataacacatttaagtataggtaaacaaagtacaaatctcagtttttcaaaacattttctgtactaatgcttttaacttgaaactcttgacttagttttgaagagaaaaaaagaatctccttggcgctcttaactattctgatgagactaagttccagagaatattttacaaaaactacttaatttaacagtacgccttgaaaagtaacactacatattctaagtgtttctggaaaaaaaaaaagaaaaggaaaaaccacgacatatttataagctaacaattcttaagagagggttactatgaatgctgtacattaatttttactttgtcagatacataacttaagaaccaaataagatgatgcataattacttctaatgatagaaagtacgagttaagtctccaaagtaatcgtgacagtgtttcatgtggaacacatttcatctacaaaaatatccataaaatacaatctagtatacctcctaggtcaatattaatgtagaaacaagaaccttctgtaataattaggttattgaggaaaatcttaagatccattttagactgaataattaagtcaaattgtttggaatttaaaatatgtgcttcatgatgatgaaataatctgtacaacaaataaccatgacataagtttacctgcggaacaaatctgcacttgtacccctggaattaaaagttacaaaatattttttaaaatatgtggttcaaatatatatattcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggtcacctgcacctagaatagggtgtcctgtgagacaaaacaattattctctatcgttaagagagattgttcaggaatcctaatagtttgacaattctgtaccagctgaacatcactagagctaactcagttgggatgtaatcaccataaaagattccattcctgtggttactgggagtcagggaggtttaagcggaatgtcactacattcaaatatgggagggagaccactttcaaaaacgaacttaaatccagagaaccatggttcttctatggtatccagtaaggggcaatgggagttggaagttgagtatgggaaatcaaattctgtgaatacggtttttctgataagatgtgtttggctagcagatcctccgcagcatctattcaataaggttaatctacatgggaaatagccatttgaagtcagcagtgaaaaattaccacttgtgaaaattttttgaaaaccaaatgatctacatatagaaacagaaaaagaaatttctgaaaggggcaaatgagatcccatttcagaagctaaagtgactgtagagtgcagaaagagcacaacatgtaggatttcccaatttttaaaaaaattcaaaactgatcttttaaaccaactcccaccacagaaggcctccctgacaacaagggcgaacgctgtgaaggagaaaactaaaggggaaaaagaatactaaaagatgccacacaaccaagctggtcagactttaaaggcctccactaccaaacaaaccacaaggctggtatcaaaaatgcgcacgcacgctcacccacgaatatgtgtgaaatataaaagaaccaaaaacatcacagggcgcacaggcagacacacactccacacacaatccccacccacccctcgccccccacacacacctcccaaaagcagggtgaacagttaaggcacctaaaaccccaagccgcataggcttccccgaaacattttacagtgtaaccaagaagcgattttgaaagcatctgaaaaacgtgcaaactgtcttgaaaacagggcctggcaactgagacagtttgcaagcgtgattcagagggtctgccaaggaaacaaaagaagcctccctcctccccgtgagaccgcacatggcacgagaggtgctccaggcgggacgcattttaagcgaggcagacaaatagaagtctgcgcgagcgcaagcggtacatactagggatcgctatctggcgaggatggggccatggagtttccattggttggggaaccgcccagctttagtttctccagatattcggcgtgcacgggcttgtggcactggagaaccttgatggcatcttcgactttgaaccactctcgcttcctcccaatgctaaccgaatcttcccaatcctccagcagctccgtgacagtcagtacatacacgtacgttctgtgcttgcgatcctggttctgttcgaagacgcccaggagccggcctaacttccccttgactcccgcttcttcgtacacctctcggaccgccgcaccgcccggctcctcctcgggctccatgcccccgcccggcacgatccagcggtccgggtaccggctgctactcactaacaggacctcgtcctcgcgttcgctccggaagcacaggcacgccgcccgcttcttgaacccctcggggtcgtaggtccgcgtctggttgggtttgcacttcatcctcgaggcagcctcctcgaggcagcctcctctcgcctctcgctgctgtgtgggccgccgctgccgctgccgccgccggggaacagccgaggtgctgggaagagaaagggccgaggcgaggggcggggaaagagaggcgcctccgtctgcccgcgagcccggggagcggagggagagatgaagctgggcggggcgcaggcggaggcgggggcagcgaggcgcgtcagccagtcggccagtccgatgggcggccggccgaacccgggcccgccggagtggaggaggtgccgccgcccgcgagcccgcgactgtccacagaccccactcgcttgtcgggggcgcgtctccctccctccgccgccgggtagggtttgagcgaggtgaggcgcattaacggacgcgtccgcgctcccgttcacgtgcgcgttcgcggcggagggcgaggggcgggggcgggggtctcctggctcccgcagcgcgcgacgcctcgggcccactgcgcaggcgccccgcacccctgggggccgagaacgtcgttcgcgcactgtgaaatacaccgcattgtgactttggccgactgcctccacgtgtgcctttgacccaaacgcgactgtagcgcggcaggacgtttctcctctccctccccaccgcgctgcacgaaacccacacgcagccgttttacacacgacagaggcaagggcatcgtcgtcatcatcctcccccacgatgaaccattctggcttactcatgggacctgggccccggtgttgtcaaaacgacccacgggattcttggcagaatagccgcgcatccttgctgagtcacatgatgcagttttatttcttcaacaggttcccaccttgccgagcatcctggcgcagctagtaatttaacgcttttcttaaacccctgttcacaacctgcctgacccctttgtgtctcagtttcctcatgggtacacttctcgcctccttgttgcagccatttgcacttcgatgcagtacaccttaaagaccagagcaccacccatctagtattcctgcgttaaagcccaagacattctctcattctccacacactccacccttgtctttctctttgataagcaccacttgggggttgggaaaccattcacgtggagatcccctcctattccacactttgatttttatttatttttatttattttattttttatttttttatggcaagaaacatttattattattattatactttaagttttagggtacatgtgcacaatgtgcaggttagttacatatgtatacatgtgccatgctggtgcgctgcacccactaactcgtcatctagcattaggtatatctcccaatgctatccctcattaaagactcaaacgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaacttacaagaaaaaaacaaacaaccccatcaaaaagtgggcgaaggacatgaacagacacttctcaaaagaagacatttatgcagccaaaaaacacatgaaaacgtgctcaccatcactggccatcagagaaatgcaaatcaaaaccacaatgaggtaccatctcacaccagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcccatatacaccatggaatactatgcagccataaaaaatgatgaattcatgtcctttgtagggacatggatgaaattggaaatcatcattctcagtaaactatcgcaagaacaaaaaaccaaacaccgcatgttctcactcgtaggtgggaattgaataatgagaacacatggacacaggaaggggaacatcacactctgggtacactttgatttttaaaagactcccgccgtgagactcccgcaaggtcacttgctgctctctcacctctctctctggtcctcctgtcctcttggccaggaaatggcatcccatcgccaaaaatttaacaacctggagccttctttcttcttatttattcttggtgtttcctcatctcatagtagccgtagagagaagaaccctgaggtcccctgattttggttgcacctttgtctctctcttactggcactctgttggcatcagccaaggggggatcatgaaagcctccttcgtttgttgatgaaatatttcctttatctaggggaaatggactcatatggaaatggagagtagtcgtgagacatacagtccaattttcaaataacagtttagttcactttcccaggatctgctcaactccacttatacccagaatcacaaataaaaatgatcctgttcccaagcacaagcaatatctgcactaacctagaccgtaatatgacaaaacgctgcgggtcatatattaacaaaattataaaatacagacataaaaagagtgacctcgatagagacactaccgctcctgaccatattttaaagatggatggacaatggaagagcatttgaaggaattcaacacttgggattaaaaacaaactaagaggctgggcgccgtggctcacgcctgtaatcccaacactttcggaggccaaggcgggcagatcacctgaggtcgggagttccggaccagcctgaccaacgtggagaaacccagtctctactaaaaatacaaagttagccaggcgtggtggcacatgcctgtaatcccagctactcgggaggctgaggcaggagaatcgcttgaacccgggaggcggaggttgcagtgagccgagatcgcgccattgccctccagcctgggtaacaggagcgaaactccatctcaaaaaacaaacaaacaaacaaaaaactaagaaagtatacttaacaggcaatatttctcagggttctcaaattcacaaacacacaaatgatgttaaacaactagggaaaactgcattacaatcaggagcaagacaagtctgcctactatcaaaaatgttattaagtattgtcttacaatttctttctagtggaatgagttgtaaagagaaaaaaatctgatatatgttggtaaaaacacaaagttgtcattatttgtagatgatgtggatatcttcttgggaaacagctaagaaaaaatgtaaaaataaatccctgtaaataaaaaaataaaatattatgatttaaaatatcagaagctttcatgcataccagcaataatcatgtaggaatttaaatgggaaatgatgacatccaacttggcactatcaaccaccacaaaacaaataaaataccaagggatcctaaaaaatatttaggacttggtagtacaaaatgtttgaacttctcagagctttgaaacatgatttgaataaatcacgagtcactctagcaaagctagcagactggtgtggtgtctgggggtgggaggggccaatccaggctccggccacagggcagggctgcttcacaattgccaggtactatctcctttgtctcacaagaatgaggtgccattttctagtctattccatcagtatcagttctacatcacaccgtgcctctgcaataggtcccttctgggggcatacttgtggcagggaagaggaataggacattataacatggaaagaggcacagaccgaaaccctactgggaaagtctggatatggagacccacaacttaaaacaggcttaatacaatagcaaggcaatgttttaattaccttttccccaaactttcacagctgacatagtttggatacttgtcctcgcccaaatctcatgttaaattgtaatccccaatggtggaagtgggacctggtgggagatgtttggatcatgagggcggatccctcatggcttggtgctgtctgtgtgatagtgagtgctcataagatctggtcacttaaaagtgcgtggcatcttcccctgtcttgctcatgctttcaccatgtgacgcaccttctccctctctgccttctgccaccattgtaagcttcctgaggccactccagaagctgagcagctgttggcaccatgcttcccgtaaagcctgcagaaccatgagccaattaaacctcttttctttataaattacccagtctcaggtatttctttataacaatgcaagaacagcctaataactttattattcatctataatattatagtaataggtcaagaaaagctaagacttgtaacaagagtaaaaatcctttttaagagaacagcattccactgtctggttttgcatatttaagtatttctccaatgatgaagagtgtaatttaggaatcactgtagtagtagactgttaaagtgaaactgcaatttgttcgtggaagcctatatctccttccacattgttgttgtatctggtcttggccatgtaatttgtggtgtccagtgggacaataacaaatgtgaacagaagccagcagagaattgaaaagtgctttcacactggggtgtcccctctcattttgcgcttaaaacattgtgacagcaatgtgaagaaggtggggctagctggatgatgagatacctgtggcagattcttccctttcaccccagctgacagtgaacccattgcccaacatatgggtgaggccatcctagaccattcggcccctagcagaactacttaggtcataacagggcgctagctgaagatgcataactaagcctagccatgaacagcaaaaaaaaaaaaaaaaaaaaaaaaaccactcagatgagatcagctgaaattactgacctgaagaattgttaacagaataatttactgttgtgtaaagcataaaatttgggggtgctttgttatgcattaaaaactagcagctccaaccattgacaccatccatcaaaatcaaccaaaagcaatcagagaaaaaaaaggttgttcgttgtagaaatgtaacgtctacttaaagatgctggcatttcactttctctggagtcagaaagaaagggatgaggttaagatatctaacatgtgttgagtacagtgcctgtgacagtccctgtgttattccctgcatcctatttaactgttatcccattaactcttagggagggaggcagttcatatgtccattttatagatgagaaaatgaggatttagagtggagtttgtatttgagctcaaggcttcgtgtctccataccctgcacactcacaacatcaacatgtcttataagaaggattattattatccacagctatggtttgttatggacttcattgataacattcagcattgacctattgggtaaggtattcagtagctaagagtcactgactccagtgaaaggtatcttccatcatgatgttcttcttctggacaataagtgaaaagagcatgtgagtacctctctcactcccagcaaataatatttgtgtcgcctccacatgttactttacgatttgaagctttgatttcccctgcaagataaaatgcaatgaagtgatacagaaaagaagacattctatgctgtcatcacactaggccatgatgttgatttatggatggtctgctttcttacatgcacttaatatttttgtataaacaaacctgaaaggtatcaaaatcccctttaacagattaacaggctgagatgggttaaagtgagcaagccgggaagtggtggagctgggatccacaccctggtctgtcttgagtccaagggtaatcgtcttgcattcactatggcatgtttcccttacgttaagagttgctgacatagacagtgcatgtcattccttttggtgtggccttcctcctttctagcttttttctgcctggaaaatccaggcacgcaagataatggagcttccatgtaaatttccagaatccctagaataaaagcggagaggatctaccctgaaaccaacaagtctaggatacacatttctgcctttttttcagaattaggaaggggcaggcagatgggcaattgacaggaatagtagaagcatcctcagggaagttgggtgctttacttagtgagaaagccatgccggctgacatttctaactgagtcttaagtggagtacagtcctaagagaggagctctccagaaacagctattacctggggtcaggaatgttaaagaccttctcagaggttgactctactcacagctggacccagctatcaggaaagggactgcaacatacctgagaagctttcagaatacttaaaggatgcagagccagaggaagtgattttggtagtagtccatgagaaaaaaatatggtgttttaaaatgcaaatgaactaaaatttaaatcctgctctctcagtagctatgcagccttaggcgagttaatatctttgaccttaatatttctcaggcgtaaagggggataataggactacctactcagaacctcacctctcccaagaaaggtttcctgaccatgtgctggcccaacctttacactgggattaaggtactcccctctgtttttccaggcttccttgactttaattctgtcatagctctaatttaggagttctgtaatgatctgtctgcaagctcgtgaggaactgtaggactaggaaccagcctgaaacatgtctgttcccctctgagtcaacacagtgcctgggatctgttgtccaatagggatttaaaacatattgattgaatgagaaatgatgacaggatctacatggatcacaaaggatagttgttattttacctgttaactatttaatagtgatattaaatgaaatatgaatgaacctaggaccagggaaggtggggtaagttgtgtctttcacatcaaccttcgtatgttccctaatgttttcttccttcatgtacctaggacactcttgtttaaatacaaaggtggttttattttgggtctatactagctagttccctagaaaggtcttaaatacaaaatgaatggaatacaaaataacctcccttattgttttgtttgtttcctggacaaatgacgggatgcatacagaactgctacttttatgattttgtgagtaatggtatagatgtgcacaggtcatggatgtggccccagtgatccatggaattgtgaagtccaggcgagtcctgcctctctcgtaatgatgcagcatgccttgatttctcccacttctttgctcactacctgatcctgtctcactgatgtcaccttccttttccctttaccctaccttgcagagacttctaattcagaaaccaaaccctttctagtggccctgtgtttatgcatcagagtaaaatgttaaatgcttccaaaacctatgaggccctacaacatctggcccatttcctctttgactttgtccctaccagtccccatgagccacacatctctagcagacctggactctgcagcttctgggttgtgtcaggcaggctccttccctcctcagggcctttgctctagccattccctctgtttggaatgctcctctgccatgtctacagagataacctcctcacccaccttgaggccttgatcacttctcaccttctggatgaggcctaccaaggccaccttatgatagattgttaaacccactcttccttgccaccctgttgctgatacttctgatccccttttccttggccgaagtttcctttctgttatagcattttgcatctaacagactatgtaattacttagtgatgtttattgcggttctctctcttagccgatgatggcttctgctagagtattagctcctgatggtagggatctttgtatcttgcaagcagcccagatctctgctgagcatacactggagtcactcagaaaatatctatggatgtaatgaatgtgtttgtgtcctgtgctagatgggagacttgtgagggaaagggccatgttttgttggtctttgtgaacccaccatccacactctctgatacaaccaaaagggctatagtgaatagtgtttgaattaattaatcttttgaaaatgacactgatagggaaaacattctctttgcaatctccagctattccagtagctgccatttgtttctgcaccatgtaggtaccagatgccatagaaacacagctgggcagccgtgagatacctgagggccagaagtctgattcattttccatggcctcttcacagggtagcacagttcctactacagagcatgacttgaggtgctgttttcagatctcagtcattcatcacctaaatggttttggttttatctgggcaggacttgtactatgatttacatattgtattttattttcataagacagtggctttcagaaagaaacatgattatataattaaatgctatgaaagcagaacgatgttatgaaaaagttgaaaataaagtggaagctattgttgtgtagtaggacacgtaactatggatgggctgcactaggcactgcatgtacctttttcatttaaccctaataaaagcccttcaaaggcaatgttgtcattcccattttcacaagggagaagattgagatttaaggccttatgtaacttggccagtatctgacagctaggaggtatctgaatgaggtggaatcttccaggctcattgatgagaacaccccacaaagatggcagtataggcagagccccaccacttaacttgcccctggagttctctctgctcccctccccgtttctcatgcacacatctctgcaacattttcctcccacctcctaacactttcagaagctcctcatcctagaagttgttctcctgctccttcggtcaagtgctggaaatttcaacactaatttctgcagaggcagaagaatggagtttgtttcaagtccttgtgaagggataaaatgattggtacttacagctgcttcaaggtcctgttgaagctggatctggaggaggatcttttatgcacagctagtccctgcgtgagagaattccggtcttggaaggatgccttcccctccacaaagacatcaggctagcccacaagggaagatagtttacttaccaataacactgtgtacccacaggctcaggccacttttgtcagaagcagaacaggctttccaaggtcaccacgctgtactaaaacttcacctaatcattagagaaagacaacatggcacatacacgtgatgtttggtatcaaaattgtgatcaggaagatggctgcattccctgttccatagtaaaacataatataccaccaatgaaatcagccagttctggagagattaccacatgatagagtgtttctgaccatgggctctgggccagacattctctgggagtgcaagatgggaaaaaatatttccttttttcaatcttttccaggttatctatttcaaggcaagtttgaaaatcaatagttctgttagcagttttcctacactacaatagtatatcctacaagtgaaagctatcacattcttagattctttcgctttagctttgatcaattagcttttactaccagcctacatctcagaaggaagcatctttgatttttgtgtcagatgaacttctctttgtgtaggattcacaaaattctaattaagaaattatattgggggaatgcggtttctcttaactacaatatcagaatatataataattgctgtttcagggcccaccatgtatgaggtgcttgacatatcttactgatagttttcttaaaatccctgtgacataagtttctttcttccagtttcacagatgaggaaatttaggctcagaggggtagattacttgtccctgttcacatggctaggaagtgcagagctgggatttaagaggcatgcatcacaatccattgcctacactggtcagcagtatccccacattttacacagtcttggaaagaaatccctgtgtctctgaaagccactaatataaattttaaaatttcatactgctgttacgtcatccctctattttagaggttgactcatgacaaatgctatttttcttttcctgtgaaatatttagtttacaacattatatttgagggtggcagatttgaaaaggtatatatatgaataagttaagtaatgttgatttacccctttttgtgtgctgaaaagtatgctattcactgtgtagaggcccatggacaaatgaatctgctttctagtcctgcgacacctaccagcttctagaagactttgcatggctcttgatacacaaaagccactttcctatgtggaaagcaaccagtgtactgcctccaatttggaagtgggtgtttttgctatcagtgtttcagtatgaaatgtattcattcagtaaaccttctgcaatgcctatatgtttatgtagtgtaactgattgatagagcatatgtaaagaccaagtaaaaactggttcttagccaggcgccgtggctcatgcctgtaatcccagcactttgggaggccgaggtgggcagatcacaatgtcagaagttcgagaccagcctggccaacatggtgaaaccccgtctctaccaaaaatacaaaatacaaaaattggccagctgtggtggcgagtgcctatagtcccagctactggggaggctgaggcaggagaattgcttgaaactggaaagtggaggttgcaggagccgagatcatgctactgcactccagcctgggcaacaagagctaaactccatctcaaaaaaaaaaattggttcttattcataaccaactcctaggaaaacaaaacaaacaaaaagaatgtaaattcttagctatactctgcacagggcgtatttccagtgaaagaggggaaaagagggagaggagataaaaaatttgatggagcaagagtagaggaaataggagcaggactcacatctggaggaatgaatccttgtgactatgaacatgcatgtctgtgcttgaaaatgctgttatttgtgagttcagaggcgtgatttcatattccggcatgtttatgcctttcacccaaacatttaaataattggattagcaatcttatattcattcattaatctccccagttaatttatttttaatcaatcactttttacttgtaaagcctaggggaatttctaaattaatcccactgtgaggacatttcagaaactgagagattattagaaaggcatcaattatgaagccaggaattcagcaatacactggtactaaaagctattgaccaatgggagctaggttaaaacaaagtccccatgtttcatgcattgtggtaggctctgggtttgataggaacatttaggaactttgcaggtgtctcatgcagaaaatcatgcaggcatatcttaaccccactgccagtggtctgtaaagatttgtcacagttatttatccgggaggtgttttacactcacacacccacacatgcacgtacacacacacacacacacacacatctcttataaattagaatcctggaatgctgattgagtcacagagctagctggtgttggagactctaaagcctcaaagaatgtctatcatacgagttttctataataagttatttagtttaattcaaagccactgcctgccactcccctggctttgcttgtctgttgtggccccacaggagaatcctggaactgaaatctctgcctcatttaaagggcagggacagaaggggcagccccagcatctgagcccttcacactgagaatgacaccgtcttacctggaagtgtcctccattgttgctgtcacacttgaagctgcctgttctcacagctacattgtaatcagtcttccctacacaatatttagcattctcaccactgtgcgtttagctatacctactttaatttgcaccttagagctacgtaggttatggctgagccaaaaatgattcttcatcttctgcagtggtttagataacgcagtgcatcattttagccacaatagatttcatatagtaataacttaaatacctgtatattcgttttctattgctgcataaaaaattaccacacacttagtggcttaaaacagcacacatttatcacttcccagtttccataagtctgccgtggatcaactgtgttctctgcctagggctttacaaggctgaaatcaagttgtcgttctcacagacacacccaggatcatgtttgctcaaatgtctgggcaccccatggcccagtcatgctgacacataaaattaaccataacaccaagcgtcttgacacactttgtaaattaaccattatattttaattccctttgtatcttagttaaatgatctatttccctggtttcatacctataaaatggagctgtgaataattttactttgttagttgcatgtttattaattaattttaaggttatatgtgttagtaggcaaaaacggttaatcaggaagtttatgttttttactacaaaagggaatttttatcaggtggcatgcagacttttaatatttatgaaattttaccacatagcaagttcttctataagctctttaaacgctttacctcatttgattcagcaacacaccataagtacctttgttatccctatgttcataggaagacatttcatatgagacacagaggctaagtaatttatcctagatgacatcttataagtggcaggcccaggattggaatctatggttgtagaaccagtcttcctatccaattattgtgaccacataatttattattcaaaatatatgaaagagagcaatattaaaattatgcctccacaattggcatacaacagaaaagttagacatatcaagccaattgctcactccgtgacagtttttttgcttacacatgacagaaaaatcttacttagactggctaattcaaaaagcaagttcataatctcacagcatttgtaacaccctcatgacatgactttttctcgctctactatgttattcctgtcagcatacacactggtgttatttttcccttgttaaaaaaatgcaagcaccaaaaacctgtttacttcactccttttacttgcttagtgctatttatctgttcccctattgcaagcttcccacagagtgtcatctacggtccaatactgtgtccaatatctctctttctattctctcttaatgatacttcagccaggcctacgcagcttccactaaacagaaactgttcttctcaaggtaaccatgacagagagattttgtcaccaccaggcctcccttacaagagctcctgaaggaagcactaaacatggaaaggaacaaccagtaccagccactgcaaaaacatgccaaattgtaaagaccatctatgctagggagaaactgcatcaactaacaaacaaaataaccagctaacatcataatgataggatcaaattcacacataacaatattaaccttaaacgtaaatgggttaaatgctccaattaaaagacacagactggcaaattggataaacagtcaagacctatctgtgtgctatatacaggagacccatctcacgtgcagagacacatagaggctcaaaataaagggatggaggaagatctaccaagcaaatggaaaatgaaaaaaaagcaggggttgcaatcctagtctctgataaaacagactttaaaccaacaaagatcagaagagacaaggccattacataatggcaaaaggatcaattcaacaagaagagctaactatcctaaatatatatgcacccaatacaggagcacccagattcataaagcaagtccttagagatctacaaagagacttagactcccacacaataatgatgggagactttaacaccccactgtcaatattagacagatcaatgagacagaaagttaacaaggatacccaggaattgaactcagctctgcaccaagcggacctaataggcatctacagaactctccatcccagatcaacagaatgtacattcttctcagcaccacaccgcacttattccaaaattgaccacatagttggaagtaaagcactcctcagcaaatgtaaaagaacagaaattatgacaccaatatttctaaatcgagtggctatttcacagtcttctccttaactgacctatttatacttttggatagagttaggccaggcgcagtggctcatacctgtaatcccagcactttgggaggccgaggcaggtggatcacctgaggtcaggatttcgaggccagcctgggcaacatgacgaaaccctgtctctactaaaaatacaaaaattagctgggcgtgttggcggacgcctgtaatcccagctactctggaggctgaggtaggagaatcacttgaacccgggaggtggaggttgctgtgagctgagactatgccattgcattccagcctgggcagcaagagcgaaactctgtttcaaaaaaaaaaaaaatttgatagagttgataactccctctactcggaagtcctttctttgctgagttccagtaaaatactctcttggtttttctgtgacctcattagctgtaactcctgagtccccttggctgattctcttcctttcctcatgacctcttgacattgaagtgcctcagaagtcaatccttggtctctctctcttctctgcctacactcattaccttggtgatcttttccagtattgtggtgtcttatgtgatctacactctcatcactgtccagtttagatagctgacctagattccacagtctatttccaattacccacctggcaagtacacatgcatgttaaataaacattttgattttaactgtgtaaaaattggatttatttcattcccctgatttcatctactttcattctttctcatctcagttaaagttaacattatcttttcagatgctcgcttagaaacagtggtgtcaatcttggcattaaattcatccagaaatactgttgggcctgcattctaaatatattgagaatgtgagcaattttgcccccctaccacttcattgtaagccactacaatttcttgcctggatggcaataacatttttactggttcatctccctgtacctttgtttctaatgattagtctcatcccagcagccagaggtatccttttgaaacctatgttggatcatgccactcctctgtcattgttctccatctcattgagagagaaaaaaatatcaaaccatttgcatgggcttcaagttcctatgtgatctgatactctgttacttctctaaaatccaacaactcccccactagatcccactacatcaaccctacctataaaaatcatactttcaactaaagactttttactggctgtactctctgcctgttattcttcctccacatacttaatagctcgttccatcaacttcattagattttgctgaaatatcacattgtgagggagccctatcctctgcaacgtccagccctatccaacttctcaaccttccagatctttcttttttttttaattttttattgtttttttttttttaagttttagctgtatcttatttatttatgtattattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtctccagagtgtgatgttccccttcctgtgtccatgtgttctcattgttcaattcccacctatgagtgagaatatgcggtgtttggttgttagttcttgcgatagtttactgagaatgatgatttccagtttcatccatgtccctacaaaggacatgaactcatcattttttatggctgcatagtattccatggtgtgtatgtgctacattttcttaatccagtctatcattgttggacatttgggttggttccaagtctttgctattgtgaataatgccgcaataaacatacgcgtgcatgtgtctttatagcagcatgatttatagtcctttgggtatatatccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctattgtttcctgactttttaatgattgcccttctaactgatgtgagatggtatgtcattgtggttttgatttgcatttctctgatggccagtgatggtgagcatgttttcatgtgtttttttggctgcataaatgtcttcttttgagaagtatctgttcatgtccttcgcccactttttgatggggttgtttggttttttcgtgtaaatttgtttgagttcattgtagattctggatattagccctttgtcagatgagtaggttgcaaaaattttttcccattctgtaggttgcctgttcactctgatggtggtttcttttgctgtgcagaagctctttagtttatttagatcccatttgtcaatttgggcttttgttgccattgcttttggtgttttagacatgaagttcttgcccatgcctatgtcctgaatggtaatgcctaggtattcttctagggtttttagggttttaggtctaacgtttaagtctttaatccatcttgaattgatttttgtataaggcgtaaggaagggatccattttcagctttctacatatggctagccagttttcccagcaccattttttaaatagggaatcgttttcccatttcttgtttttctcaggtttgtcaaagatcagataggtgtagatatgcagcgttctttctgaggactctgttctgttccattgatctatatctctgttttggtaccagtaccatgctgtattggttactgtagctttgtagtatagtttgaagtcaggtagtgtcatgcctccagctttgttcttttggctcaggattgacttggcaatgcggactcttctttggttccatatgaattttaaagtagttttttccaattctgtgaagaaagtcattggtagcttgatggggatggcatggaatctgtaaattaccttggccagtatggccattttcacgatattgattcttcctacccatgagcatggaatgttcttccatttgtttgtgtcctcttttatttcattgagcagtggtttgtagttctccttgaagaggtccttcacgtcccttgtaagttggatccctaggtatttcattctctttgaagcaattgtgaatgggagttcactcatgatttgactctctgtttgtctgttgttggtgtataagaatgattgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattaaatacactttatttccttctcctgcctaattgctgtggccagaacttccaactctatgttgaataggagtggtgagagagggcatctctgtcttgtgccagttttcaaagcgaatgcttctagtttttgcccattcagtatgataatggctgtgggtttgtcatagatagctcctattgttttgaaatacgtcccatcaatacctaatttattgagagtttttagcatgaagagttgttgaattttgtcaaaggccttttctgcatctattgagataaccatgtggttttcgtctttggttctgtttatatgctggattacatttattgatttgcatatattgaaccagccttgcatcccagggatgaagcccacttgatcatggtggataagcttattgatgtgctgctggattcggtttgcagtattttattgaggatttttgcatcaatgttcatcaaggatattggcctaaaattctcttatgtggttgtgtctctgcccagctttggtatcaggatgatgctggcctcataaaatgagttagggaggattccctctttttctattgattggaatagtttcagaaggaatggtaccagttcctccttgtacctctggtagaattcggctgtaaatccatctggtcctggactcttcttggttggtaagctgctgattattgccacaatttcagatcctgttattggtctattcagagattcaacttcttcctggtttagtcttgggagggtgtatgtgtcgaggaatttatcaatttcttctagattttctagtttatttgcatagaggtgtttgtagtattctctgatggtagtttgtatttctgtgggattggtggtgatatcccctttatcattttttattgcgtctatttgattcttctctctttttttctttattagtcttgctagtggtttatcaattttgttgatcctttcaaaaaaccagctcctggattcattaattttttgaagggttttttgtgtctgtatttccttcagttctgctctgattttagttatttcttgccttctgctagcgtttgaatgtgtttgctcttgcttttcaagttcttttaattgtgatgttagggtgtcaattctggatctttcctactttctcttgtgggcatttagtgctataaatttccctctacacactgctttgaatgcctcccagagattctggtatgttgtgtctttgttctcattgctttcaaagaacatctatatttctgccttcattttttcatgtacccagtagtcattcaggagcaggttgttcagtttccatgtagttgagcggttttgggtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgcatattctgttgatttggggtgaagagttctgtagatgtctattaggtccacttggtgcagagctgagttcaattcctgggtatccttgttgactttctgtctcgttgatctgtctaatgttgacagtggggtgttaaagtctcccattattaatatgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttcatctttgttggtttaaagtctgttttatcagagactaggattgcaacccctgcctttttttgttttccatttgcttggtagatcttcctccatccttttattttgagcctatgtgtctctctgcacatgagatgggtttcctgaatacagcacactgatgggtcttgactctttatctaatttggcagtctgtgtcttttaattggagcatttagtccatttacatttaaagttaatattcttatgtgtgaatttgatcctgtcattatgatgttagctggttattttgctcattatttgatgcagtttcttcctagtctcgatggtctttacattttggcatgattttgcagtggctggtactggttgttcctttccatgtttagtgcttccttcaggagctcttttagggcagacctggtggtgacaaaatctgtcagcatttgcttgtctgtaaaggattttatttctccttcacttatgaagcttagtttggctggatatgaaattctgggttgaaaattcttttctttaagaatgttgaaaattggcccccactctcttctggcttgtagagtttctgccaagagatccgctcttagtctgatgggcttccctttgagggtaacccgacctttctctctggttgcccttaacattttttccttcatttcaagtttggtgaatctgacaattatgtgtcttggagttgctcttctcgaggagtatctttgtggcgttctccgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggagggtttgttcttttctttttattcttttttctctaaacttcccttctcgcttcatttcattcatttcatcttccatcgttgatactctttcttccaattggtcacatcggctcctgaggcttctgcattcttcacgtagttctcgagccttggttttcagctccatcagctcctttaagcacttctctgcattggttattctagttatacattcttctaaatttttttcgaagttttcaacttcgttgcctttggtttgaatgtcctcccgtagcttggagtaatttgatcgtctgaagccttcttctctcagctcatcaaagtcattctccgtccagctttgttccgttgctagtgaggaactgcgttcctttggaggaggagtggcgctctgctttttagggtttccagtttttctgctctgttttttccccatctttgtggttttatgtacttttggtctttgatgatagtgatgtacagatgggtatttgatgtggatgtcctttctgtttgttagttttccttctaacagacaggaccctcagctgcaggtctgttttagtacccggccatgtgaggggtcagtctgcccctgctggggggtgcctcccagttaggctgctgaggggtcaggggtcagggacccacttgaggaggcaatctgcccgttctcagatctccagctgcatgctgggagaaccactgctctcttcaaagctgtcagacagggacatttaagtctgcggaggttactgctgtctttttgtttgtctgtgccctgcccccagaggtggagcctacagaggctggcaggcctccttgagctgtggtgggctccacccagttcgagcttccccactgctttgtttacctaagcaagcctgggcaatggcagccgcccctctcccagcctcgctgccaccttgcagtttgatctcagactgctgtgctagcaatcggcgagactccgtgggcataggaccctccaagccatgtgcgggatataatctcctggtgcgccattttttaagcccattggaaaagcgcagtattggggtgggagtgacccgattttccaggtgccatctgtcaacccgttctttgactaggaaagagaactccgtgaccccttgcacttcccatgtgaggcaatacctcgccctcttcggctcgctcacagtgcgcgcactgacctgcgcccattgtttggcactcccttgtgagatgaacctgggacctcagatggaaatgcagaaatcacctgtcttctgcgtcgctcacgctgggagctgtagaccagagctgttcctattcggccatcttggctcctccccctagctgttgtttcctacagatctttcttaacttcctctaattttttccatgctgttataatcttctgacatacagtaggatgtaattattcattttatttactgtttgtataattacatggaaatatgagttccatgagggtagacacagttctctgctttatttgctgtagtatctttagggccctcaatcgtgcccgtagttagttattcttcattaaatatttggtctatttccaaaccagactggaagtcaaaagtaggtggattccatacatggggaactctggctctaggatgccatgaagagttcagatttttttcctctcttcttcgccactctcagtgtccttaacatgctggtctcaagacggctgaagcacttttaggtctctgatctgggcatggtaatgtttacagacagaaaggaatatatcttccaatgtgccttttcaaagagacaagacccatgacatagtacttcccagaagatatccccacagtcaactccaacgtatgggactgaattaggtcacgtgcccatttcaaaaccagtgaatttcaagaatattgactggcttagataaacaggagacagaatggatgttggggagtcaatcacaatgtccactgaaacacatcagtgccctggtgtgattggatgtgtgtgcttgtgtgtgtgtgtgtgtgtgtgtgtgtgtgtgtgtgtgtgtgtatgaacctgaaaatgagctgatttctggaacataaatgttacaaaatgaaaagaaatagattagggtaattaatcagtttgattaaggttattaattggtttaaggtaattaagatgggaaagagctgacatcttgcatggatacatttttgtctgttaatggtatgagactagcatcattcaatatttccatctcatactaggtaatgctttgacagtgggaccagaaatcatgtagagacttgtttttcccacacaatgcctatgtgggtatttccagaatttcctttcacggatgactgacaaaccccctcctgactgatacattcttcatgtagccatattaatacctttattcaaatcttagtgtttctttgacctggaatcaatcttattcttttttcttggtttcagcttaaagtgcataaaacggatatacaaagataaataatgaataattataaagtgaaaacctgtgtaaccacaacccaaaacagtgaaatcaaatattgataaaaccctggaacccattatgtccgcatccctaaccaccactgtctatctcctcaatagaggttcccaccatcctgctcattgtttagaatctctactttgctgctcattagaggtttgatactcattatagctttgccacctatgtaaacaactaaagtaccttgttcagtttgtcacagttttataaaatcacatctctgctcagagtttttacagtacatttaaataataaccttatttaacttggttatggaggctttcagaaatgtttaaaagcaaactctctttccacattaaagggacaacagatattccttgggtacctactgtgtgcttaggagtgaagaaagtactggagtatccatgagagctaaattgtgctgtctaccttcactgagattagagtctagttgaaaagatagtgcctaataatagtgtacagtgttagaactgaatatagttcagttatgcagcaaggccatgggtattgcaatgaggcattccatgtaccacctcttattggctctgtaactctgggaaagtctctgcacctttctgagcctgtgtattcactttgaaaagagagagagatttaaaagctgctccctaggattgttgtgcatggtatattgtagcctctaaatgaatggcagatattttactatggtacattgggctagtcagaaggaaggctgaaaataattaaattcccactgaacatatatatttagctcatatagaagcctaggcaccttagtacactctagatgttagagtgaggatatttggctccaggaacacacataggcagctaagtggaatggtaagagactagatattaagatcagaaatgtttgggccaataattttaataaggatgaaaggtatcctttgttgagtaattaattatatgactctcaaaacttagaatcttacctctggtaggcacctcagagacatggttagacctgagtccttggaaccagaactgtctaatcaaatgttgtcctctataaacaagaaagaatttaaaaatcaatgagagttaacttttaatgtgtattcgccctgtccaaatattgctgaaaacatgtgcatcatctcgtttaatccttaccatggccctaggacataggcaagctcaatgattatcctttcttacagatcaaaaactttgaattcagaaattattcataatgtttctgctatcacacagctgataaatgaagtagccacaaatttattctagttgttattcagagctcacattactttccttgggggaggtactttttttctgagataatttcaaacttgcttacaaaaaaagttgcaagaatgagacaaagaacctccttttgtacttctccctaatacctccacagttaacatttgacatatttttacacttgctctctgtctctgtctctctcaatacacagatgcataagcacagacacattttcatatatgtattctaaaccatttgagagtgagctagagacatgttcttttactcctaaatgcttcagtgttatttcctgagaataaggacattgtcttacataaacagtataattatcaaaatgttatctttattaacattgaaacaatactattatctatctcatgtacaaattttattcaaaagtgaccagttatcccaataatgtcatttacagagttttctaattttctgatctatgatccctctagtgtcatgtgttttatgtagttgttacttcactttagtcttttttatttttattttttataattttaactcactatagtcttctttagttttgaacaagtcctcagattttctttgtctttcatgaccaaaacagttctttaatgtgtgggctatttactagagtgtcctttaatttcggtttgcctggttttctatcctcatgattagattcaatttatacatttttgtctggaatagcacaaaatgatagtattttcttctcaatgcattacatctgttggcaaagtacttatttattccataactggtaatgtcaaatttaatcacttaattaatgttgtattcagcaggttatgtcaagtaaagttactatattttctttgaaattgaagtattctgtggtgagatacttggatactgtggacatatcctgtcttgtcatccactaatacttctgcctgagtccactaatgcataactgttggaaaatgatgtctttctataataacactttcttttcctacttaaaaatatatttatttatttaatcaacaaataaaaatcatatatatgaatcatgtataacatgatgttttgaaatatgtatacattgtggaatggctaaaatgagctccttaacatatatattacctctcatacttattatttcttgtggggagaacacaaaatctactctcagtgattttcaagaatacaatacagtgttattaaccatagtcaccataacgtacagtgggtctcttgaacttattcctcctatctaactgaaaatttggatccttgatgaactgctcaccaaccacctcctctcaatttcctggtagctaggattctactctctccttccacgagttcaacctttttagattcctcacataaataagatcatgcggtctttgtatttccctgcctgggttacttccgtttacacaatgtcatccaggttgtcgcaaatgacaggatgtcttttgtttttgttttttagagacagggtttcactttgtcacccaggctgcagtgcagtgatgcgatcatggctcaccgtatccttgacctctgggacccaagggattgtcccaactcaacctcctgagtagctgggaccaaaggcatgtgccactatgccacattaatttttatttttttgtggagacagggtttcactatgtcacccaggctgttctcgaattcctgggctcaagccatcctcccacctcagcctcccaaagtgctgggagtactggcatgcatcatcatgctcaggcaggatttccttcttttttaaggctcaatagaattccgttatctcctaccttttcttgattcattcacctgctgagggacatttagttttattccatatcttaactgttttgaatagtgctgcaatgaacacaggagtcatgagagcctttcaacatttaataagttggcattgtactgtcatgaagagttttcccattgtatttgtcagagttctctagagggatggaagtaataggatatatgcctatatgaaagggagtttattaaggagaattgattcacacgatcacaatgtaaagtcccatgataggcggtctgcaagttgaggaagccagtggtggatcagtctgaatcccaaaacctcaaaagtagggaagccaacagtgcagccttcagtctgtggccaaagacgggagagaacctggcaaaccagtggtgtaagtccaagagtccaaaagctgaagaacttggagtttgatgttccagggcaggaagcaccaacaggggagaaagatgaaggccagaagactcaggaagtctgctcttccatcttctcctgcctgttttattatagtcatactggcagttgattatacggtgcccacccagattgagagtgggtctgcctttcccagcccactgactcaaatgttaatctcctttggcaacaccctcacagacagacccaggaacaatacttagcatcattcaatccaatcaagttcacagtcaatattaaccatcacacccaacttcttcatttatttacttatttatgtatttacttatatcattataggttcatgggtatatacttaatcactgggtaatgatagattaccatcaaaatttattttgatactcaaattggccagcatttggctagttgaagtgccttgaaacttcctgtacctttttgtcatatatccatcttagctggaacactttctttactttctagtgcaacaagatgttcctgcctgtttgtactttccctgttccagcccttgagtcagacatttctctaaaaagcctcagtttattttagtgtacaatgctttttacaagcaagtctgcactctgaatcacctgtctctactgacaatatgactttgaaaccctccaaactttccttaattctatttacccagtgtgtaaatgcacataaaaataggatttttgtctaggtatgttgcgaggtttaaaataaggtattgggccaggcgtggtgtctcatgcctgtaatcccagcactttgggaggccaaggtgagcggatcacctgaggtcaggagtttgagaccagcctggccaacatggtgaaaccctctctctactaaaaatacaaaattagcctggcatggtggagcatgcctgtaatcccagctacgtgggcggctaaggcaggaaaatcgcttgaacccgggaaccggaggttgcagtgagccaagatcatgccactgcactccagcctgggcaacatgagtgaaactccgtctcaaaaaaataaataaataaaatttaaaaataaaaacataaaataaggtattgaaagcatttagcactgttcatggcacaaaagtaattttggtaatttgaccatttgaacatgagaatgagtaataatcataataataacgggttgtgacccaattaataaaatcagaatccataagaccaattgaaaataagtgggagctattttatcaccatttttgttattatcaaatacccttgacagtgaataagttttacctctaggaaaaatttcaagtttacacttatagccttgtcaagcaaaagtaagatctgcagaatcacagagcttgagaaagtaccaatatgggggaatgattccagaagcaggcaggccttaggccttgatgactggcaggacttcactgtttgaaacaaaaaagattaagtgaagaacagcaactactcctacaacccctgctaccagaaccccatatttcccctatcatagccgcaaatccactgttccataaatagttacttgtctgtgtacttcattagactgagagctgatagttgtgacttatttgccaacttatccccaatgcctgaaatggtgtctgtagataggagacattcaataaatgtttgctgaatgaatgaatgaaagtattaataatttcaaatatgtcgtgaggataattaatgagagaaggaaactgagactcagagaagtagggaagcgtgcccaaggtcatacaactttttttttctttttttgagacagagtcttgttcttgttgcccaggcgctggagtgcaatggtgcaatctcagctcacttcaacctctgtctcctgagttcaagtgattctgctgcctcagcctcccgagtagctgggattacaggcacccaccaccacaccaggctaacttttttgtatttttagtagagacggcctttcaccatgttggccaggctggtctcgaactcctgacctcaggtgatctgcctgccttagcctcccaaagtgctgggattacaggcctgagacaccatgcctggcccaaggtcatactactattttagtaagagagagagggaggcagaattccattctgccctgactctagtagctttgggtgtattggcctctctagatactgagccttcccagtaagattaacttgtctgatttccatgtttaccagagttcaaatgggagtcccatatgtgccaaactatgtatgcaagactggttcaagggtttggtaattaattcaacaactatttattgattgctcaatataggccttacaggttctggagatacagcagtgagtacaacagatggataacctcctcttatcaacattccattctggtgcacagagacagaaaataaggggatacagaaaacttaagatggtaaagaaagtaaagcttgattaacaaatagaaaattacccagcatgtgtgtgtttgaaggagggagtggctatggaggtgagaggaggcttgttaagttcagaggacctggaggaattttctgtgtctggaattagaaagggatgcaggctgggagttgaggtgagaaattagaaagtcgaaacctcaagaaaataagccacttaatgtctatgagactaagtgttctcacctgcaaaacagggattcaaacatttgaggtaccgtgtaaaaaatgtagtgtaaagctcaaatctgaaaacattaatgttattcagctgatttattgaacaataatagcagctggtacttttgaatgcttgctgtttgttaggcagtatgctagttgctttccatgttaatttcatcctctgcaatgaaaagtagttagggtttttatattttataaggttggatagcaactgattgcaggtattaggattaaagcccaggctcagtctgtcaaacttgaaaagcttgttctttttcacaagtttgtgcttccagaatcgcaaacaggcaactgatagtgaccaagatgaattgagtggtacaacatttaaaagacagttataaaacttacttagcatagcatttatataattattaatgaaaggaaaaataatgatttattatttatatttcaatcttagtatctaaacttatatttttatattttattaaattaatttctaaaattcttacactagcacataatactaagtgtttgtatttttagaagtgacataagattttctttttaaagttttattttatttttagttggcatttaataattgtacacacttatggggtgcaatgtgatgtcttgatatatgtatacattgtgtaatgattaaatcaggataattagcaaatacatcataccaaatattgattattttttgtattgagaacattcaaaatactctcctctagctattttacaatatagaatatattatcgttaactatcgtcaccctactggacactagaacatcagaacctctttctcctccagatggaagatcaacaaggaaatatagaactgaacaatgttatagacaaaatagacccaacacacatataaggaacattccacccaacagcagcaaaaataatcattcttctcaaatgcacatggaacattctccaagatatctcatagtagaatctcatatcaagtcttaacaaatttaagaaggttgagatcaatctaagtatcttttctgatcacaactgaatgaaactagaaatcagtaataaaaagaaaatgaggaagctcacaagtgcatggaaattaaataacacgctttgaaacaattattatgtcaaagaagaaattgaagatgaaattagaaaatatattgagacaaaggaaaaccaaaacacaacacagtgaaacataacatgcagccaaatcagcactaagaaggaagtttataacaataaatggtttattaaaagaagaaaaaaaaggaaagagctccagtaaactaactttctccctcaaggaactagataaagaagaacaagcaagtcaaagttagcagaaggaagtaataatgaaggttatagcagaagtaaatgaaatagagaatagaaaaacaatttaataaaattttaaaaaccgaagagttttttgaaaagataaataaaatggacaaacccttagctagactaataacaaaaaagaaaatattcaaataatacaatcagagatgaaagaagagacatcccatggctgggggtagggagagctataggaactattatgaacatttaaatgttaataaattggataactcagaagaaattgaaaaattcctagaaacataggacccactgagactgcatcaataaaaaatataaagcccagacataccaaaaaacaaataatgacattaaaagaataatcaaaaatgtcccaacaaagaaaaatacaggaccaggtggcttcatagataaattctgtgaaacattaaaaaaattaataccaatcttactgaaagtcttctaaacaacagaatagggaatacttacaaactaattctatgaggccagcatcaccctgatacaaaagccagagtaagacaccagaagaaaagaaaactacagactaatatccctgatgaatatagatgcaaaaagcctcaaaatattattagcaagccaaatacaaaaatgcatttaaagactcatacaccatgaccacataggagttatgcctgtgatacaagaatcgttccacatatgcgaattaatcagtgtgataaaccacatgaatagaatgaaggatgaaaattacatggtcatctcaacagattcacaaaaaacatttgacaaaattagacacctctttatgctaaatattttcaacaaattaggtttagaaagaacttacctcaatataataaaggccatagaggaaaatcccacaattaacatgatgctcaatgatgaaaagctgaaagatttactcctaagatgagaagcaagacaaagatgcccactcttggctctcctatttaacataatacagtcattcctcagtattcatggggaattggttttgggaccctcacagataccaaaatccgtggttacatttgtataaaccaacaatgacctatctgtaaagctgatttcaggaaacaatttgactcacaattgcacaacaaataaaatacttagaaataaatgcaggtggctgggcatggtggctcatgcctgtaatcccagcactttgggggactgagacgggcagatcacctgaggttgggagttcgagaccagcctgaccaacatggagaaaccccgtttctactaaaaacacaaagttagctgggcatggtggcccatgcctgtaatcccagctactcagggaagctgaggcaggagaattgcttgaacctgggaggcagaggttgtggtgagccaagattgtgccattgcactccagcctgggcaacaagagtgaaactccatctcaaaaataaataaataaataaaaacaaataaatgtaggtaaaggaggtaaaagggttgtacactgaaaactacaaaacattgacaaataatttttaaaaagcagaaataaatggaaacatctcatgatcatgtattgagaagaattgatattattaaatgtccatacttcccaaaatatctgaagattcaatgcaatctctatcaaaatctctatggcatttttgtacagaataaacaatcctaaaattcagaagaccctgaatagccaaacaattttgaacaagtacagagctggagttatcacactccctgattccataatgtgtcacaaagctgcagtaatcaaaacagtatggtactgttataaaagtagtcatatagaacaatggaacagaatagagagctcaaaaataaatctactgggtgccaagactacactatgtggaaggatggtctctttgatacatggtgttaagaaaattgcataggaatcgaaatcacaggaatcgaaatctggatctccaagagatgagtgtattcccatgtttgttgcaacattattcacagtagccaagatatggaaacaacctcagtgtctgttgatgatgaaatactattcagccttataaaagaaggaaatcctgctgtttgtgtacctggaggacattaggctaagtgaaataagtcagatcacagaaagacaaatactgcatgatctcagttttactgtatgtgaaatctaaaattgttaaccatatagaagcagatagtagaatggtagtggccaggggctgagggaagggagaaatgcaggtggggtgttggttaagcgatacaaagtttcagttatgtgtaataaataacatctgtaggtctagtgtataatacagaacctatgattttatactcaagtttgctgagagggtaaatcttcattaagtgctctcaccacaaaaaggaaaataaaaaaacaaagagggcaggaggaaactttcagaggtgaaagataagattatggcattgagagtgatgatgttgtgatcatttcatgggtgtatactcgtctcttaacacatgatgttgtgtacattaaatatgtacagctttttgtaaaaaaaaaaaagccatataaacgttgcgataaaagtagcatccattgcttttcctgtctgcagtctataatatattaatttattaaaacatcaaacactcgattatgcacaccgtatttccagaagtaatctgtaccctgaacataccatgatcaatgaaacatggcctttcatcatcagggatttcatgatctcctcttggaggcataacacatcaatgaaaagggactttaaaaaggaactgtaggccgggcgcggtggctcacgcctgtaataccagcactttgggaggccaaggcaggcagaacacctgaggtcgggagtttgagaccagcctgaccaacatggagaaaccccatttctactaaaaatacaaaattagccgggcgtggtggcacatgcctataatcccaggtactcggggaggctgaggcaggagaatcgcatgaacccaggaggcagaggttgtggtgaaccgagatcgtgccattgcactccagcctgggcaacaagagcaaaactccatctggaaaaaaaaaaaagtccaggaagtccagaatgtactggtactagaagttcctgaaaacagcaatgatcaactacaaaaacattctccaagtaaagataatctgaggacagcagtagcctgtattcattaatttatcatgaatttttccaactaataaatagctcataaaataatagctatgttttattgggcaatgatcagaataggaatcatccacattcatacaataagtatttattgagcacctgctagacaccaggttctaggctgtatgccaaattttaaagtcacatgtgacacaggctctatcacatatatcaatgacttctcagattaatgaaaatacacagatgaacagataattactgggttatcaggagaaccataacagaagtaaacacagtgaacactaagaacagagaagggaatgctaactcaaatggtctaaagtgcttctcatcacttatgagatggttgctattattgtccccattttttatatgaaaaaacctaggaacagagagaatggtgcaggaatatagcaggcactcataatttgtggaatgcatgaaagtttacttcaccaacaccaaatatctcaaaaatagatattgtagtaaagccaattaatttttaatttcaaaattaatagaggatttttagaagggttttaggcttacagaaaaatgagtggaaagtacagtgaatttccaaatacccccccacactctcctcctccattattaacacttgcattagtgtggtacacttatcacaattgataagccaatattgacacatcattattaactaaatttcacagattatattacggtttgctctttgtattctacacttctatggattttgacaaatatattacaggtattcattattacagtatcatacagcatagtttcactgccctaaaatcccctatactccacctattcacccctccctctttccctacaaacttcagacaactactgaacgttttgctctttccatatcatgtcctatagttggaatcacgccatatataaatcttttcagactggctgcttcttcttttttttttttttttttttgtcagatggagtctcgctctgtcgcccaggctggagtgcagtggtgcggtctcgtctcactgcaacttccacttccccagttcaagcgattttcctgcctcagcctcctgagtacctgggactacaagcatgtgccaccaagcccggctaattttttgtatttttagtagagacggggtttcaccatgttagccagaatggtcttgatctcctaaccttgtgttccacccaccatggcctcccaaagtgctgggattgcaggcatgagccaccgcaccgagcccagaatggcttcttttatttatttatttatttatttatttattcatttattttttattattatactttaagttttagggtacatgtgcagaatgtgcaggttagttacatatgtatacatgtgccatgctggtgcgctgcacccactaactcgtcatctagcattaggtatatctcccaatgctatccctctcccctccccccaccccacaacagtccccagaatgtgatgttccccttcctgtgtccatgtgttctcattgttcaattcccacctatgagagagaatatgcggtgtttggttttttgttcttgcgatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgcgtgcatgtgtctttatagcagcatgatttataatcctttgggtatatacccagtaatgggatggctgggtcaaatggtatttctagttctagatccctgaggaatcgccacactgacttccacaatggttgaactagtttccagtgccaccaacagtgtaaaagtgttcctatttctccacatcctctccagcacctgttgtttcctgactttttcatgatcaccattctaactggcgtgagatggtatgtcattgtggttttgatttgcatttctctgatggccagtgatggtgagcattttttcatgtgttttttggttgcataaatgtcttcttttgagaagtgtctgttcatgtccttcgcccactttttgatggggttgtttgtttttttcttgtaaattcgatggagttcattgtagattctggatattagccctttgtcagatgagtaggttgcgaaaattttctcccattttgtaggttgcctgttcactctgatggtagtttcttttgctgtgcagaagctctttagttgaattagattccatttgtcaatttgggcttttgttgccattgcttttggtgttttagacatgaagtccttgcccatgcctatgtcctgaatggtaatgcctaaattttcttctagggtttttatggttttaggtctaacgtttaagtctttaatccatcttgaattgatttttgtataaggtgtaaggaagagatcccgtttcagctttctacatatggctagccagttttcccagcaccatttattaagtagggaatcctttccccattgcttgtttttctcagggttgtcaaagatcagatagttgtagatatgcggcattatttctgagggctctgttctgttccattgatctatatctctgttttggtaccagtactgtgctgttttgcttactgtagccttgtagtatagcttgaagtcaggtagtgtgatgcctccagctttgttcttttggctcaggattgacttggcaatgcggactcttttttggttccatatgaactttacagtagttttttccaattctgtgaagaaagtcattggtagcttgatggggatggcattgaatctataaattaccttgggcagtatggccattttcacgatattgattcttcctacccatgagcatggaatgttcttccatttgtttctatcctcttttatttcgttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgtacactgactttgtatcctgagactttgctgaagttgcttatcagcttaaggagattttgggctgagacaatggggttttctagatatacaatcatatcgtctgcaaacagggacaatttgacttcctcttttcctaattgaatgccctttatttccttctcctgcctgattgccctggccagaacttccaacactatgttgaataggagtggtgagagaggtcatccttgtcttgtgccagttttcaaagggaatgcttccagtttttgcccattcagtatgatattggctgtgggtttgtcatagatagctcttattattttgagatacgtcccatcaatatctaatttattgagagtttttagcacgaaggattgttgaattttgtcaaaggccttttctacatctattgagataatcctgtggtttttgtctttggttctgtttatatgctggattacatttattgatttgcatatattgaaccagccttgcatcccagggatgaagcccacttgatcatggtggataagctttttgatgtgctgctggattcggtttgcccgtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagacggaatggtaccagttcctccttgtacctctgatagaattcggctgtgaatccatctggtcctggactctttcgttggtaagctattgattattgccacaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgcctatttgattcttctctctttttttctttattagtcttgctagcagtctatcaattttgttgatgctttcaaaaaaccagctcctggattcattaattttttgaagggttttttgtgtctctatttcctttggttctgctctgattttagttatttcttgccttctgctagcttttgaatgtgtttgctcttgcttttctagttcttttaatggtgatgttaggatgtcaattttggatctttcctactttctcttgtgggcatttggtgctatatgtttccctctacacactgctttgaatacgtcccaaagattctggtatgttgtgtgtttgttctcattggtttcaaagaacatctttatttctgccttcattttttcatgtacccagtagtcattcaggagcaggttgttcagtttccatgtagttgagtggttttgagtgagattcttaatcctgagttctagtttgattgcactgtggtctgagagatagtttgttataatttctgttcttttacatttgctggggagagcattacttccacgtatgtggtcaattttggaataggtgtggtgtggtactgaaaaaaatgtatattctattgatttggggtggagagttctgtagatgtctattaggtctgcttggtgcagaggtgagttcaattcctgggtattcttgttgactttctgtctcattggtctgtctaatgttgacagtggggtgttaaagtctcccattattaatgtgtgggagtctaactctctttgtacgtcactcaggacttgctttatgaatctgggtgctcctgtattgggtgcatatatatttaggatagttagctcttcttgttgaattgatccttttaccattatgtaatggccttctttgtctcttttgatctttgttggttgaaagtctgttttatcagagactaggattgccacccctgcctttttttgttttccatttgcttggtagatcttcctccatccttttattttgagcctctgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatcatattagctggttattttgctcgttagttgatgcagtttcttcctagtcttgatagtctttacattttggcatgattttgcagtggctgataccggttgttcctttccatgtttagcgcttccttcaggagctcttttagggcaggcctggtggtgacaaattctctcagcatttgcttgtctgtaaaggattttatttctccttcacttatgaagctcagtttggctggatatgaaattctgggttgaaaattcttttctttaagaatgttgaaaattggcccccactctcttctggcttgtagagtttctgccaagagatccgctcttagtctgatgggcttccctttgagggtatcccgacctttctctctggctgcccttaacattttttccttcatttcaactttggtgaatctgacaattatgtgtcttggagttgctcttctcgaggagtatctttgtggcgttctctgtatttcctcaatctgaatgttggcctgccttgctagattggggaagttctcctggataatatcctgcagagtgttttccaacttggttccattctccccatcactttcaggtacaccagtcagacatagatttggtcttttcacatagtcccatatttcttggaggctttgttcgtttctttttattcttttttctctaaacttcccttctcgcttcatttcattcatttcatcttccatcactgataccctttcttccagtgatcgcatcagctcctgagtcttctgcattcttcacgtagttctcgagccttggttttcagctccagcatctcctttaggcacttctctgtgttggttattctagttatacattcttttaaattttttcaacgttttcaacttcgttgcctttggtttgaatgtcctcccgtacgtagcttggagtaatttgatcatctgaagccttcttctctcagctcgtcaaagtcattctctgtccagctttgttctgttgctggtgaggaactgcgttcctttggaggaggagaggcgctctgctttttagagtttccagtttttctgctctgttttttccccatctttgtggttttatctactttttgtctttgatgatggtgatgtacaggtgggtttttgatgtggatgtctgtttgttagctttccttctaacagacagggccctcatctgcaggtctgttggagtacccggccatgtgaggtatcagtctgcccctgctgggggttgcctcccagttaggctgctgaggggtcaggggtcagggacccacttgaggaggcagtctgcccgttctcagatctccagctgtgtgctgggagaaccactgctctcttcaaagctgtcagacagggacatttaagtctgcggaggttactgctgtctttttgtttgtctgtgccctgcccccagaggtggagcctacagaggcaggcaggcctccttgagctgtggtgggctccacccagttcgagcttccccactgctttgtttacctaagcaagcgtgggcaatggcggccacccctcccccagccgcgctgccgccttgcagtttgatctcagactgctgtgctagcaatcagtgagactccgtgcacataggaccctctgagccatgtgcgggatataatctcctggtgcgctgttttttaaacccgtcggaaaagcacagtattggggtgggagtgacccgattttccaggtgccatctgtcaccactttctttgattaggaaagggaactccctgaccccttgtgcttcccgagtgaggcaatgtctcacccttctttggctcgtgcacggtgtgcgcacccactgacctgcgcctactgtctggcactccctagtgagatgaacccggtacctcagatgtaaatgcagaaatcacccgtcttctgcgtcgctcacactgggagctgtagaccggagctgttcctattcggccatcttagctcctccccagaatggcttctttaacttcgcaatatatatttaagtttcctcaatgtttttgtggccagatagctcatttcttatccttgaataaaatgtcattgcatagaggtaccacagtttgtttcttcattgacttattgaagtatattttggctgtactatggtttgaatatttgtcacttcccaaacttaaatgttgaaatttaatcctccgtttggcagtactagtactagtggggaggctttaagaagtgattggggccaggcgtggtggctcacacctatattcccagcactttgtgaggccaaaatgggcagatcatgacgtcaggagctcaagaccagtatggtcaacatagtgaaaccccgtctctactaaaaatacaaagaattagccgagtgtggtggtatgcacttgtagtctcagctacgtggggggctgaggcaggagaattgcatgaacctaggagacaaaggttgcaatgagccaaaattgtgccattgcactccagcccaggcgacagtgcaggactctgcctaaaaaaaaaaaaaaaaaaaaagtgattgggtcatgaagactttgccatcatgaatgacttaattcattcatggcttaatgcattgatgggttatcatgggattgggactggtggctttataagaagaggaagagagatcatagttagcctgctcagctttctcaccatatgatactctgccttgcctcaggactctgcagagtacccaccagtaagaaggccctcaccagatgtgaccccttgaccttggacttctcagcctccataactgtaagaaataaattagttttcacataaattacccaggtccaggtattatgtataaacagcagaaaatagactaagacaggccacttccaagttttggcaattatgaataaaactggtacaaatatttgtgtacaagtttttgtgtaaatataattttcatctcatttgggggttcaattgctgatcatatggtatgaatatgtgtaattttctaagaaattgccaaattgaattctaaagtagctgtaccatttttccttcccaccagcaatgaatgagagtttccatcactccacatcaagcatttgacagtgttttgaattttagtcattctgataagtttatgaaagctttttatcatcgtttcagtttgcaattccctaaagacgtatgtcattgagcatctttttatatgcttatgtgctatctgtacattttgtttggtgaggtatctgttcctatattttgcccgtttttaagttggttgtttagttttttattgttgagttttaggagctgtttgtatattttggatactagtcctttattggttatgtgttttgcaaagattttctcccagcctggtcattaagagtgtgttttgtagtgcagcttttattttcaataaagcctgaaatcaattttttctttcagagattgtaattttggtattatatccaaaatataatagtcaaaccgaagatcaccaagattttctcccctgccagcttctagaagttttataattttgtgttttacatattaacaattacatgggtaattgataaaagatgtaagatcttttgataaaagatcttttgataaaagatataagatctatatctagattctttttttgtgcatgtagaactgcatgcaagcagttcatttgttgagaagtctgtcctttctccattgaattgcctttcttcttttgtaaaagatgggttatctgtatttgtatgagtctatttctgggctctctattctattctcttgatctatttacttattcttttgccaatactaaactatcttggctcctgtagctttatagtgagttttgaggttgggtaatgtgagtcctccaattttgttcttcttcaatactttcatagctattctgattttttgtctttctatgtaaactttagaatcagtttgttaatattgacaaagtaactaactgcgattttgattggaaatgcattgaatctatagatcaagttgggaagaacttgattgctcgacaatattgtgtcttcctatttatttacatggaatatttccccatctgtttagttcttctttgaattatttcaccagtgttttaagcagtttgacttatgtatattatacttgtatcccatgacctcgttataattgcttattagttccaagacttattttattgcttctttcgaattttcaacatacacaattatgtcatctgcaagcagacagtttgatttcttacttcccagtttgtataacttttatttccttttcttgtcttattgcattggcaaaattttccaatcaaaattcaaaaaagagtagtgatagtgaacatccttcttttttttcttgatcttagggggaaaacatctagtttcttgtgattaactataatgctaactgtagattttttgtgtgtagatattcttttccacagtgaggaagttcacctttatgcttagtttgctgtgtgtttctattgctagttggtcttagattttgtcaaatgcttattctccgtctacttatatgatcacatcccttttttctttagcctctcaatgtgatgaatcacatcaattgatttgcaaatgttgtcccagccttgcatacctggaataaatcccacttggttataggtgtataattatttctaaatattattggagtcaattcactaatattttattgaggatttttgcatctatgttcagagtggatattggcctgtatttccatttcttgtaacatccttcattttagtattagggtaatgttggactctagaatgagtgaggaagtattcactttgcttctattttataaagaagattatagaaaattggcataattttttccctttaatgttaggttaaattcaccagtgaacccatctgggcttgctgaactttgatttgggaagattatttgaaacttcattccagatgattattaattattgatttcattgctttaataggtgtaggactatttatgttttctatttcttcttaagtgggttttggtagattgtgcctttagaaaaattggtgcatttgctcttcaaggagaactacaaaccactgctcaacaaaatgaaagaggacacaaacaaatggaagaacattccatgctcatggataggaagaatcaatatcgtgaaaatggccatactgcccaaggtaatttacagattcaatgccaccctcatccatctaccaatggctttcttcacagaattggaaaaaactactttaaagttcatatggaatcaaaaaagagcctgcattgccaggacaatcctaagccaaaaaaacaaagctggaggcatcatgctacctgacttcaaactattttacaaggctacagtaaccaaaacagcatggtactggtaccaaaacagagatatagatcaatggaatggaacagagccatcagaaagaataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacctaggcagtaccattcagggcataggcatggggaaggacttcatgtctaaaacaacataagccaaaattgacaaatgggatctaattaaactaaagagcttctgcacagcaaaagaaaccaccatcagagtgaacaggcaacctatagagtaggaaataatttttgcaatctactcatctgacaatgggctaacatccagaatctacaaagaactcagacaaacttacaagaaaaaaacaaacaaccccatcaacaagtgggtaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcatgaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagccatcccattactgggtatatacccaaaggattataaagcttgctggtataaagacacatgcacacgtatgcttattgcggcactattcacaacagcaaagacttggaaccaacccaaatgtccatcaatgatagactggattaagaaaatgtggcccatatacaccatggaatactatgcagccataaaaaatgatgagttcatgtcctttgtagggacatggatgaagctggaaaccatcattctcagcaaactatcgcaacgacaaaaaatcaatcaccgcatgttctcataggtgggaactgaacagtgagaacacttggacacaggaaggggaacatcacacaccggggtctgtcgtggggtggggggaggagggagggatagcattaggagatatacctaatgtaaatgacgagttaatggttgcagcacaccaacatggcacatgtatacctatgtaacaaacctgcacattgtgcacatgtaccctaggaattaaagtataattttcaaaaaaagtaagaaaaattggtctctttgatctacattatcaaatttgtggactagacttgttcataatattcctaattttccctttggtgttactgagatcagtaataaggcccctatttcatttctggcattagtaatttgtgtcttctcttttattcttgttatccttactaggggtttatcaatttcattaacctttcaacaaaaaaacaggttttggttttgttgattatttctattgatttactgttttcagttatattgatttctactcttaagtttttattatttttctttttagtttagatttaatttgctcttatttttctaatttcttacggtagaaacttagatcattgattttagatctctcttattttctaatatatgtattcaatgctgtgaattttcccataagcactgctttcactgcattatacaaattttgttgggctttcattttatttagttcaaaatattttaaaatttatcttgatatgtcttccttgacccgtgtattatttagaagtgtgttgtttaaccttcaggtatttggggattttccagatatctttctgttattgatttttattttgataccattgtggtctttgcgtgatttcttttcatttaaatatgctaagttgtgatttatggcaaataagttgatctgacttggtgaatattccatgtgtgcttgagaagaatgtgtaaattgccattttttgatgttttctataaatgtctgtcagatccagttgattgttctgttcagttcaactatgtccttaccaatttttttgcctgctgaaattgtcaattacattctctccaaatctaaaagtctccaactacaatagtggactcatctatttctccttgtacttctatcggtttttgtctcacatattttgatgctctgttgttaggtatatacacattaagaattgttgtcttctggagaattgacccctttatcaatatggaatgcattttctttatctttgataattttccttgctctgaattctgttttgtttgcaatttatgtagtaagcttggctttttattaattagtgttagcatagtacattgttatccatcattttgcttttattctattcatgtctttatatttaaagtggatttcttatagataacatattgttgtgtcctaattttgatccactctctctttttcttttttgagatggagtgtcgctttgtcatccaggctggagtgcagtggcattatcttggctcagtgcaacctctgccttctgggttcaagtgattctcctgcctcagcctcctgagtagctgggattacaggcacacaccatcacacctggctaatttttgtatttttagtagagatggggtttcaccatgttgatcaggctggtctagaactcctgacctcaggtgatccatccaccttggcctcccaaagtgctgggattataggtgtgagccaccatgcctggcccactctgtcttttaactgatgagtttagaccactgacatttaaagtggttatcgatatagttggattaatatctatattgggttaatatttgctactgttttctttttgttgttgttgttgttgtattttttgtagagatggagttttgtagagattggccaggctggtctcaaactcctggcctcaagtgatctgcctgcctcagcctcccaaagtgctggaattacaggtgtgagccaccatgcccagccattatttgttactgttttctattcaagccaattttcaaaactacatctttatcctttctttacacaaatactctcttttaataataatgtcattctctttaatacagcggtactggctacatttcctgggctttgcttgcccatatatttaaagcttaaatcggctaaggagagtatataattgatcaggagacaacttgtagagaaaaactgcttgaaggtctctgtttttgcctgacacctaacttaatcctcacaggacaattatgaggtatcctctgacaagagagagttgacatcattttcctaattccacaacagaagaagcagaaacacttgctgaggcatctcaggtcatgcactgaaagtcatattgccagcaaggggtgcggtgggatttgaatccaggtagtctgatcctgtgcccatgctctttaacttagtcacactaagcagatggtgccctcatagttttgaagggggtgagccaggtaagccaatatcctctgtgatctgctactggggccagggaagaagtatgttccttgaatgctccatgctctctcaggcccacaggacctcatgcatacatgctgttcctctgcctggacaattcatcacccaccttccactcagcttccagtcagctgccaaccaccttctactcagctaactgccactcagccttcacacctgaaattactggccactcacttggggagaatgtcccccctaaacaaggttatagtttcctgccacatgccattagagcccactgaattctatcacactgcacattcatcagggttgaagattctttacttgttgtatgcctcccccagaagatgatgaaacccctgaaatcagggtccttgtctgcccttcccaaccctgaggccccaaatccccactgcacagaagtgtgaggtccagagatcttaaaggaatcgtgtttttgctgggaacaaatggttagtggtgacaggaagtgggggtgctaacatatacaattattcaacacctctttcctgttcatcctggaaaagttaggggtggatgaaaagttacagctaaaggattgacatttttgtggaatcaaaaccaatggatttctaggagagagactggttaggttattggattataatacatacctgtgggattatatatttgaacaaactaatacattaagataaaatgctcaaaggcagatacctaaatagagatgttcactttacacagtaattaatactagaacagccattgaggttttaaaaagtgaacattgtagtatactatattagtctgctctcacactgctaataaagatgtacctgagactgggtaatttataaaggaaagaggtttaatggacttgcagctccatttggctggggaggcctcacaattatggcagaaggcaaaggagaaacaaaggaatgtcttacatggcagcaggcaggagagcatgtgtagggaaactcccctttataaaaccatcggatctcgtgagatttattcactatcacaagaacagcacaggaaaatcctgtccccatgattcacttacctcccacttggtccatcccacaatgtgtgggaattctgggagctacaagtcaagatgagatttgggtggggatgcagccaaaccatatcatatactaagtgaatgaaacagaaattaattgaaattaaacaatgtctgtaacagagcgcctgttacatggtgggtgctcaataagtattagttatataagtaagtttatgcatcattttctcctttagttggtatttgtggagtacttactatgtgcttcacctgggccctatgtgctctctgaaaagctttctgtgtttcctcagtaagtactctctcctgttctacatacagctttttcaaattatcttacctttcataagaccagttctctgacttatcaccaccccccatacccagtcatagcataaaatctggcctactaaatcaccaaggaaagggaaaatatatctagtaattttttaacttttttgctacattatagttaatacaccaaaaagatcacccattgtaactctaaattgagacaacttataggaaatgtttacagttgtacaaacatcattactatgcagttcaagaacacttttgttatcaataaaagttcccttgtgaccatttttaacagctttattgtggtataattgtcatataataaaccatgtgtgtttaaaaaagtgtacaatttgatgttttgacatatgtatagacttgtaaaaccatccctacattcaagataatgaatatatttatcacccctaaaagttttgttttgaccctttatcattcattcttcataccctgctcacttcttcttatgctcatgcaatcattgaactggcttctattcttttttattaatttgcatttcctagagttttatatcaatgccatcagctatactatgtatttttctggcttctttcactcagataattattctgagattcattcgtattgtgtgtatcaatagttcctttgtttttattactgagtaatattccattgtatgactatgccacaactaaccattcatcagttaatgggcagttacgctgtttccagtttaggggtattacaaataaagtgtcaatagacattcaggtaaaactgttcacatggtgtcttaatctgttttgtgttgctgtaaaagaatatctgagactgagtaatttataaagaaaatatgtttatttggcttacaattctgcaggctctgaagtacaagaagcatgatgccagcatctgtttggcttctggtgagggtcatgtgtcggtcaaaacatggtggagaaggccaaaggagaagcagacacatgtgaaaacagaggacctgagggacatcctggctttataacaacacactctcatgggaactaatccattctcagagaagaaatccagcctttcaagaactcagtaccatgagaatggcaccaagccattcatgaaggatctgtccccatgacccaaacacctctcaccaggcctcacctctcaacactgccacattgagaatcaaattgccacatgagttttgttggggacaaacaaacctcatccaaaccacagcacatagatatatattttctttactctttgttaaatacatagtagtggactggctggaccatatgatacttatatgctttttaagtaactaaaaaactgttttccaaagtggctgtgcaattttacatttcaactgggagcatatgagagttctagttcttccacattcttataacacttggtatggtcagactttttaaattgtagacattgtaataggtatgtagtggtgtctcattggggttttagtttgcattcccccaattactgaagatgttgagcatattttgatgtgcttacttgacatctgttcaaatcatttgcccatttttaatttggttgtttgttttattgttgtattttgagagctctttatatattatagatatatgtactttatcagatacatgctttgaaaagagtttttacccagtatgtggctttttttccattcttttatcattgtttttctaggagcactttttactatcggtgaaataaatttaacaatttgttatgttgtggattgtgctttttatgtcatatctaagatatcttcacataaaccaacatcatgaagattttctcccatcatttcttctagaaattttataaatttagattttacagttagagctttggtctattctgagttgcgttttatggtatgatatatggctccaactttaatttttgcatatggatatccaattattttgtttaagaaagtctatccatttctgcactgtcttttgcacctttgcaaaaacaaaaaataagttgtccatttctgtttgggtttgtctgcactttctattttgttccactgatctatttatcaatctttacatcaatactgtggtgttttgattactgttgctttgtaaaaaaacatttgaaataaagtggtagtagtccttcaatttcgttctttttcagagttgttttgaataatttaggtacttttcattttcgtatttcatatttcatatagcattttcttgtcaatttttgcaagaaaagccagctgtgatattgactggtattacattgaatgtatacatcaatttgggaataaatgatgccttaataacatcaagtctttgaaccagttaagatatatctcttcatttacttaggtcttcattaatttttccccaccatattttgttgttctcagtgtactggtctgatatggtttggctctgtgttcctacccaaatctcatgtcaaattgtaatacccatgggtcaggggagggacctggtgggaggtgattggatcatgaaggccgatttctcccttgttgttcttctgatagcaggtgagttctcttgagatctggttgtttaaaagtgtgtggcacttcttccttcactctctctctcctgcctccatgtgaagaaggtccttgcttcctcttcgacttctaccatgattgtaagtttcctgaggcctccccgtcatgcttcttgttaagcctgcagaactgtgagtcagttaaacctcttttattcataaattacccagtctcagataattctttatagcagtatgaaaaaggactaatacaagatctttcatgtgttttgtaagatttatccttaagtacttcatattttacgctcttgtaaatgattatgtagtttcaatgttcaatttttttattgcttatatatggaaacacaatttttgtatcttgactttgtagttccctaccttgataaatgtgcttatagttccaataggtttttgaagatttcatctaattttctaaatgagcgattacatcatttatgaataaagagagttctacttcttcttttccaaactctgttacttttcgttttcttactgacttcactgcctagaaccaccagtctaatgcggaatggatgtggtgagtgtagacatttctgtattcctcatggtgtgtgtgtgtgtgtgtgtgtgtgtgtaaggggagaccttccttcctcccttccttccttctttcctctttttctctttctttcttttttctttcttccttcctttgtctttctttctttctttctttctctttctttctttctttctctttctctctctctccccttccttccttccttcttccctccctccctcactccctccctttcttccttccttcctgcattccttccttctttcttgcttcttagagacggagtcttgctctgtcacatagctcactgcaacctccacctcctgggttcaagcaagcctcccacctcagcctcccaagtagctaggactacaggcatgcaacaccatgcccggctaattttttaattttttgtagagacaggggtcttcccctgttgcccaggctggcctcaaactcctggcctcaagtgatcctcctgcctcagcccgcaaagtacttggattacatgtgtgagcaactgcattcagaaagttttttgttgttaaatatgttagctgtaacatcatatttatacacatcctttataaggttgagaaaattttctttcatttctagttttctcccagtgcttatcaggaatggatgttggggtttctcaaatgctttctctgcttcaatggaaatgatcaaatgatttttcattaaagtttgctaatatggtaaattacattgatggtttttgattgttaaatggctgggcatggtggctcatgctgcctgtaatcctaacattttgggaagttgaaatgggaggattgcttgaggacaggagttcaagacaagcctgggtgaaatagtgagacccccatctctacaaaaaatacaaaaaaaaaagtaaaaaaaataagcagccctgaattccagggataaaacctagctgactatgatcatcatatattcctttaatcattttgatatagttttatttaattcctttaacatatttataatactcgctttaaatgctttgtctgctcaatataacatgtgagcccattcagagtaactttctattgccagggtttttttcccattttgttgcgtcataagttttgtttgtaaactagatattttagatagtgttttatagcaattctagattttgttttattttttacttattttttttgcaagcttcaaacattttattttattttattattattatactttaagttttagggtacatgtgcacaaggcgcaggtttgttacatatgtatacatgtgtcatgttggtgtgctgcacccattaactagtcatttagcattaggtatatctcctaatgctatccctcccccctcccgccaccccacaatcatccccggtgtgtgatgttccccttcatgtgttcatgtgttctcattgttcaattcccacctatgagtgagaacatgcagtgtttggttttttgtccttgcgatagtttgctgagaacgatggtttccaacttcatccatgtccctacaaaggacatgaactcatcattttttatggctacatagtattccatggtatatatgtgccacattttcttaatccagtctatcattgttggacatttgggttggttccaagtctttgctgttgcgaatagtgctgcaataaacatacgtgtgcatgtgtctttatagcaggatgatttataatcctttgggtatatacccagtaatgggatggctgggtcaaatggtatttctagttctagatccctgaggaatcaccacactgacttccacaatggttgaactagtttccagtcccaccaacagtgtaaaagtgttcctatttctccacatcctctccagcacctgttgtttcctgactttttaatgattgccattctaaatggtgtgagatggtatctcattgtggttttgatttgcatttctctgatggccagtgatgatgagcattttttcatgtgtctgttggctgcataaatgtcttcttttgagaagtgtctgttcatatcctttgcccactttttcatggggttgtttgtttttttctggtaaatttgtttgagttcattgtagattctggatattagccctttgtcagatgactaggttgcaaaaattttttcccattctgtaggttgcctgttcactctgatggtggtttcttttgctgtgcagaagctctttagtttaattagatcccatttgtcaattttggcttttgttgccattgcttttggtgttttaaacatgaagtccttgcccatgcctatgtcctgaatggtaatgcctaggttttcttttagggtttttatggttttaggtggaacatgtaagtctttaatccatcttgaattaatttttgtataaggtgtaaggaagggatccagtttcagctttctacatatggctagccagttttcccggcaccatttattaaatagggaatcttttccccattgcttgtttttctcgggtttgtcaaagatcagatagttgtagatatgcggcattacttctgagagctctgttctgttctactggtctataactctgttttggtaccagtaccatgctgttttggttactgtagccttgtagaatagtttgaaatcaggtagcatgatgcctccagctttgttcttttggcttaggattgacttggcaatgcaggctcttttttggttccatatgaactttaaaatagtttttttcagttctgtgaagaaagtcattggtagcttgatggggatggcattgaatctataaattaccttgggcagtatggccattttcacattattgattcttccgatccatgagcatggaatgttcttccatttgtttgtatcctcttttatttctttgagcagtgatttgtagttctccttgaagaagtccttcacatccattgtaagttggattcttaggtattttattctctttgaagcaattttgaatgggagttcactcatgatttggcctctgtttgtctgttattgttatataagaatgcttgtgatttttgcacattgattttgtatcctgagactttgctgaagttgcttatcagcttaagaagattttgggctgagatgatggggttttctagatatacaatcatatcatctgcaaacagggacaatttaacttcctgttttcctaattgaatgccctttatttccttctcctgcctgattgccctggccagaacttccaacactatgttgaataggagtggtgagagaggtcatccctgtcttgtgccagttttcaaagggaatgcttccagtttttgtctattcagtatgatattgactgtgggtttgtcatagatagctcttattattttgagatacgtcccatcaatacctaatttattgagagtttttagcatgaaacgttgttgaattttgtcaaaggccttttctgcatctattgagataatcatgtggtttttgtctttggttctgtttatatgcttgattacattattgatttgcgtatgttgaaccagccttgcatcccagggatgaagcccacttgatcatggtggataagctttttgatgtgttgctggattcgatttgccagtattttattgaggatttttgcatcaatgttcatcaaggatatttgtctaaaattctctttttttgttgtgtctctgcccggctttggtatcaggatgatgctgacttcataaaatgagttagggaggattccctctttttctattgattggaatagtttcagaaggaatggtaccagctccagcttgtacctttggtagaatttggttgtgaatccatccagtcctggcctttttttggttggtaagctgctgattattgcctcaatttcagagcctgttattggtctattcagagattcaacttcttcctggtttagtcttgggagggtgtatgtgttgaggaatttatccatttcttctagattttctagtttatttgggtagaggtgtttctagtattctctgatggtagtttgtatttctgtgggatcggtggtgatatcccctttgtcattttttattgcatctatttgattcttctctcttttcttctttattagtcttgctagcagtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggagtcaattttagatctttcctgctttctcttgtgggcatttagtgctataaatttccctcttcacactgctttgaatgtgtcccagagattctggtatgttgtgtctttgttctcgttggtttcaaagaacatttttatttctgccttcattccgttatgtacctagtagtcattcaggagcaggttgttcagtttccatgtagttgagcagttttgagtgagtctcttaatcctgagttctagtttgattgcactgtgttctgagagacagtttgttataatttctgttcttttacatttgctgaggagtgttttacttccaactatgtggtcaattttgggataggtgtggtgtggtgctgaaaagaatgtatattctgttgattaggggtggagaattctgtagatgtctattaggtctgattggtgcagagctgagttcaattcctggatatccttgttaactttctgtctcattgatctgtctaatcttgacagtggggagttaaagtctctgattattattgtgtgggagtctaagtctctttgtaggtcactaaggacttgctttatgaatctgggtgctcctgtattgggtgcatatatatttaggatagttagttcttcttgttgaatttatccctttaccattatataatggccttctttgtctcttttgatctttgttggttgaaagtctgttttatccgagactaggattgcaacccctgcctttttttcttttccatttgcttggtagatcttcctccatccctttattttgagcctatgtgtgtctctgcacatgagatgggtttcctgaatacagcacactgatgtgtctggactctttatccaaattgccagtctgtgccttttctttggagcatttagccaatttacatttaaggttagtattgttatgtgtgaatttgatcttgtcactatgatattagctggttattttgctcgttagttgatgcagtttcttcctagcctttatggtctttacaatttggcatgtttttgcagtggctggtactggttgttcctttccatgtttagtgcttccttcaggagctcttttagggcaggcctggtggtcacaatatctctcagcatttgcttgtctgtaaaggattttatttctcctccacttatggagcttagtttggctggatatgaaattctgggttgagaattcttttctttaagaatgttgaatattggcccccactctattctggcttgtagactttctgccaagagatcagctgttagtctgatgggcttccctttgagggtaacccgacctttctctctggctgcccttaacattttttccttcatttcaagtttggtgaatctgacaattacgtgtcttggagttgctcttctcgaggagtatctttgtgacgttctctgtatttcctgaatttgaatgttggcctgccttgctatattggggaagttctcctggataatatcctgcagagtgttctccaacttcgttccattttccccgtcactttcaggtacactaatcagatgtagatttggtcttttcacatagtcccatatttcttggaggctttgtttctttttattcttttttctctaaacttctcttctcgcttcatttcattcatttcatcttccatcactgataccctttcttccagttgatcacatcggttactgaggcttgtgcagtcgtcacgtagttctcgtgccttggttttcagctccatcaagttctttaaggacttctctgcattggttattctagttatacattcttccaatttgttttcaaaatttttaacttctttctcattggttcgaacttcctcctttagctcagagtagtttgatcttctgaagccttcttctctcaactcgacaaagtcattttccatccagctttgttccattgctattgaggagctgcgttcctttggaggaggagaggcactctgatttttagagtttccggtttttctgctctgttttttccccgtctttgtggttttatctacctttggtctttgttggtgacgtacagatgggtttttggtgtggatgtcctttttgtttgttagttttccttctaacagtaaggaccctcagccacaggtctgttggagtttgccggaggtccactccagacgctgtttgcctgggtatcagcagtggtggctgcagaacagtggatattggtgaactgcaaatgttgctgtctgatcgttcctctggaagttttgtctcagaggagtacctggtcgtgtgaggtgtcagtccgcccctactggggggtgcctcccagtttggctactcaggggtcagggacccacttgaggaggcagtctgtccattctcagatctctagctgcatgctgggagacacactactctcttcaaagctgtcagacagggacatttaagtctgcagaagttattgctgtcttttgtttgtctgtgccctgcccccagaggtggagcctacagaggcaggctggcctccttgaggtgtggtgggctccacccatttcgagcttcctggctgctttgtttacctactcaagcctgggcaatggcaggctcccctcccccagcctcgctgccaccttgcagcttgatctcagactgctgtgctagcaatgagcgaggctctgtgggtgtaggaccctctgagccagtcacaggatataatctcctggtgtgccatttgttaagcctgttggaaaagcacagtattagggtgggagtgacccgattttccaggtgccatctgtctcccctttctttgactaggaaagggaattccctgaccccttgtgcttcctgggtgatcatgcacggtgtgctgcacccactgtcctacaccgtctggcactccccagtgagatgaacccagtacctcagttggaaatgcagaaatcacccgtcttctgcatctctcacgctgggagctgtagactggagctgttcctattcagccatcttggctccactccctagattttgttttaattatatgaattttttctggagagttgcctggctttagcattgtaatttgtcatctcatggcaagaagccactgaggtctctgtttaatttttttatccttgtttttattttttattctggattcctattagtcacccctgtatctgcatatcttagtgatcaggcaatggtttggccagagattgttttaaaaaacctgaagcctgtaaagcttctacactcagctgaccaatcaatccatcaatcaatctgtgtgtggattggggagcacaataaacatttcagtcaattctcaagcctgccttcacttttacttttctctgagctctcctgggtctctcccatacatgtgcatattttcccagtcacacaggatatatgaagacctactgttgtgcattcattttcaaaatctctttattaaattcctctctgatcctctgcttgccccactgtaacctcaaacttaggcaaccaaatggacagattttaccatttgattcctaatgagtatacaactcttaactaataataacccagcttttcaccatctgacccaaatggaattcacccactgggagaaaagctgctaaattgttttggtcggcacatactgtaaacctatccttctcaccttgggatctaaggagattgaggggtgggctggatggaagaagccccatgcaaggacacagattcttttacacacagatctagcagtttttcaaggttaaacacttattaataatttgtttaccttgagtatattttcagagccccaaaacacttgtttttgacaattttgtccagccttattcttgtatttggcaaaaaggattaaccaaactcttcaagccaccataaccagaatttcacatcaggtgtaattttcctcattttctttcaactaaacctaaaaacttttttgtagtcattctcttattagttagttattgctgcaaaacaaatgacaccaacacttagtgcttaaaattatattgatttatttaactcttcttactctggtgagcaatttagtcttagctcacctagccagttctgatctctgctggattcatttacatttgtgtgatcaactggtagattgactgggagctggatttttttaagatggccccagataagatgtctcatctcttctgtatgtggtctgtcatcctccagccaattgacccaggatttcaaatgtcagctgagtaagattccaagagggaaagcagaagtgtgcaaggattctttaggcctatactcagaattagcaaaatatcatttattccacattttattagtcaaaaggttgtaggaaaatctgggttcttttcacatgaccaggaaagattaggcttgcagacactttgaaaggtgaggggaaacagaatttattggtcaagaaaggaaaaagagagaaaaactttcagtagagtgagagggaagcctgttaactggatctcatcccaccacacaggaactcaagagactgggctcctctgcgaatggcgtgacattccatgacaccatactcttctcccagtgtgcaggccagttggagtttctttgggaccagcagtccggtttttcagcctttaggctgttttagtcttgaaggcagggttttgctgggcagcccttggctgcctcctgtctctaccattcccccttctaaagaagtacatctaactgtccctagagtaagaataaagataaggatgaagactgatctcaactgcttcctgctgagagggggtgctgttttgggaaaatggcagtcagatctccctcagagagaggtctgaggctcctgttgcatgaccatttggactttgatggcctgaaggtgagataagacaaaccaggttattagaaaacatatcaaaatgaaacaagggtgagtaaggacagcttaggaattctgaggcctgttaccagtttgcatggggagagggaagccaataactggactggcaaaaacacttttacccttttgatggcatgtcagacttctgggttcccttcccttgagcccaaccctaagccaaccagtttaaagtttgggaaattaactttccccattttggaagatgcatccaaggggagtgtcccatagtatggagacacaattacctattggtgaagagaggacagaggaggagaaaagaaagaagaaagcgttttttttcaaaggagtcccagggttttgggatgcatttgaaaggggtacagactgaagatggatggctactcttctagtaagaggggagcaggtatccctggttcccttctcttcccagcaaatacacagggtacatgagggggagaaagtgaggcactcctctttctttcctccatctttgtatccccgagtcccagtgaccacaacaggttgccacccatgagtgccaaagcagcttgcacctatgaagcagggatggcctagagaataggaattatccactctcacctgtgcctctatccccgctactgtcagtagccttggagttcactagacctcacttatgctatacataccagcttgacatttatccatgaaactggaggcttggcttaatcaacaggaattagccaagctcacctgcactgtacctttaacctctgttatcaactgcctctggatccctcagatccaattttctttcctagggctttgacccaaagcttggaataaggttgggaccaaaatgtgtcttggggagattgcatggattccttattatcagctgcatgctaaggtgaagctgtggaattgagtcctcctcaaacaaggtagagaagaggatgtctcgtgacatgcccagacaacttgtggctatacttatgcttgttaagatttgggcacatgatgcttggctttggttagcaaccttggtctcactttcccaaaaaggaaacctctggctgatgggcaccctatttattcccatacctggcaggatttgcaagataattgctcagaacaagaatattgatccagatttctacagtacccatctcttttgttctttctgagctgcagccagagattgctagttggttcacaggaacaagcagcgttagtctaaaatgtaggcaaaaacttaaaaacaactaataagtctagaatttaatgacaagtgtatgataagttttgaaacaaaatttctgtctctctaatcctaatttttgttaaaagaaatcatgataggactgagtcgtttgcaaaatagactttagttttagacttagcctgattatttgcataaaatgcagcaagaataactatttctacataggccttttagattggctttgctggaactctgttccataaggaatctcagataagaccttttaaagctgagcccagccatgggtttttatcctcaaatacatgtgagttgggtgatcctctcctcttaaggtcccaagataaacttggagctcctgggcctgttagaaagtgacattctttactgaccacaagtaaggaacgctgtacagggactgcgtagatgagggtatgaggccagtttccccgaggggcttttatcagctctgcaaatcaagcttgactccttaaaggggagcatacccttccagtcaaagccttggtaaagcaaccagtttcttcaactgcatcctgttgcaaaagaaaatggattcttattgcactgatgcaaacagctagattaacacgagttaagaatactcacagatagcttctaaattctagaggaaccaggccaaaagaaacaaacatgctttaaattttgttcacaggagtataccttactcaattattaagggccataaatagttcaaaataagtttccttgactctgaaaaacaaaacaaggatcagcagtattccaagcaaaaataaaaaaggttgcgtcagtttcctgagttcattctgttggctcttgttttgcttgatattcacgaacatttcagctcttcatgagccctgtatgtttttcctttattccaatgtcacaatctccaaagttatcagaaacttgtatttgagagcacttgtcaaagttctatagcttattataaaccattttttgaaaaggattaaaacaagacaacaattgtctgtgaataacaaaatgtctagggtagttacagttagaaacacaattgacaaagaagtttggttatctctgtcatttacaataacttaacataacaaacttaattatgattgatagcattatactttagacattagaattttgggctgggaacagtggctcacacctgtaatcccagcactttgggaggctgaagcaggcagatcacttgaggttaggagtttgagaccagcccgcccaacatggtgaaaccccatctctactaaaaatacaaaatttagccaggcatggtggcatgtgcctgtaatcccagctacttgggaggctgaggcaggagaatcacttgatcccaggaagtggaggctgtgctgagccaagatcatgccaatacactccagcctggatgacagaatgagactctgtctcaaaaaataaaataaaaaataaatagatattagaatttttggaatcccatacaattttggaacatatattggtattattctccaaaatataacttaaagaagattgaacattattttgcaatttcatgcaactaaaattgtcaaataatcctgtttacctctcatctctgaacattccaggggcccttctgaagtatctgaaaagctaggtgtcaagaaagacaattttgaaactgaagtttgattttgggaagcctattacatgtgttagaggtttgaaacacttggtgttatgaaatagaattccagattaccataaattatttagtttcccaaaataatgactcagaaatgtttaaaaagcaaaacaaccttttataaacctttacaaattttgctaaagagcagattagtgccttgggagtaccttgttttgcttttattttaatcctcaatttacagaaaaaccatataatacccttttgaatttaatcaatatgttcacacagagaatttcttttacaagattgatttttacaatccttcctccacttgtttgaacctttagctttatcatatctaatttaaaacaattctttaacccaaggcaagaatttacatttttatgccttcttataaccttttattacaaacacattttatgttcttatacacctcgcatgtaaatctattttcagtagtttcaattacatttcataatggtaactcctagcaatttttaactttaatgtaaaacctggtaagttgttttaattttctaagtacagccaagatttgactccttccagtagaattaggggcatggttagttccatatgtccccaggccttaccaagttgaacaggcattaccaagttgaacaaaaaccaaaaagcagtgtataaccttaaaacactcagcaaacctttcatcttacctgcataatttagtccacttatttatattttaatgacatctgcattttaccaataatctttatagctgtttttatttctcaaagattaaagtcacatgaactaaaaggtaccacttttatcttacctttaaaaaatatttgatccaagtgcttatcttcctttaggccaaattaattagagttctttttacagatatcacatatacaacacatatataactatacagacaggcagaagaaaatccagttgccataaaatcttccatcagaggagaaggatctatccacttttaattcctggggttcttatgagaaaaatagaggtctcttgcctcatacatgcatcgagagtggcaagacaaaatcaagaaaaataattcagctgactgagaacaaaaaacctttttccagcaaaggagatccaaggaaagaaaacataaaggccttttaaatataaccataatttggatatgcacttttaatgaagctgagcactccttaagaaaaccattttaggccaggcacggtggctcatgcctgcaatcccagcactttgggagacagagatgggtggaacatgagatcaggagttcaagaccagcctgaccaacatggtgaaatcccatctctactaaaattacaaaaattagccaggtgtggtggcacacacctgtaatctcaactactcaggaggctgaggcaggagaatagcttgagcccaggaggtggagattgcagtgagccaagatcatgccatcgcactgcagcctgggtggcagagtgagactgtgtctcgaaaaaaaaaaattgctgggcatggtggctcacgcctgtaatcccagcactttgggatgccaaggcaggtggcttacctgaggtcaggagtttgagagcagcctgatcaacatggagaaaccccatctctactaaaaatacaaaaattagccaggcatggtggcacatgcctgtaatcccagctactctggagactgaggtaggagaattgcttgaacccgggttgcagtgagctgagatcgcaccaatgcactccagcctgggcaacaagagcaaaactctgtctcaaaaaaaaaaaaaaaagaaagaaagaaaatcattttaactcccttattatctgactttagccatgccaatcagccaatatttctggctttcaaactttgctaaaggctcagagaaaggacaatccaaggtggttcgtggaggggaggggaatcaacaaatagcaaaaggtcatgcagatataaaaccagaaaggactcataccctaagccaggattgaatccgcaccacaacagtgagaatgccaaatcctaaccaccggaacaccagggagagaagcttaattgctgttggatgaagctggactccctagctggaaaagaaggagaatccactagatgcatggtggggaacacaggccagcctgctgttgggcacccttgggccatgcattccagccctggctgtgaagggagttggggggccaccattccccactccatcctgcacatgcctgcagccactgggatgtgccatttcctctaccctcagaagagatccgaggagaaaaaaggcttagaagcaaaaggaaaaaaggttttttgttttgcatgatactcacccttcctcaagccccatgttgggtgccaaaaaatgtaggaaaatccgggttcttgtcacaaccaggaaatattgggcttgcagacactttgaaggctgagggaaatggaatttattgggtgaaaaaggaaaaaaagaaaaactttcagcagagtgagaaggaagcttgttaactgactcctgccccaccacacaggaactcaagaggccaggctcctcccctctgcaaatggtgtgaacttctgtggctccaccccattctcccagttcacaggccagttggagattcttggggactggcagtctggtttttcagacttcgggctgttttaggtttgaagacaaggttttgccaaggctgggcacgaggatgccttggctgcctcctgtctctatcaaaaccaagtcacaagaccagtataaaatggacaaatcaggcaaaaaaaaaaaaaaaaagatactgactttgtttataggtagttccacgaaaaatcgtcataatggatggatttgtcccttatgtgttttcatttccagacaccccttatttatttgtaagtagaaaaattatttcctttccaaatatggatgtttaatgttactcgatattttccttctactcaataatgatcaagagtcataatgataaacatgaataatttgtaggtcctgattacattgcaggtcctgattacattgctgctacaataattatttttggtccaattttatggatgaagaaaatatgatttactgagtaattgccccaaggttaagaaataggtaagcatagatttgaatccatgtgtgtctttccagatcttgtgttctttccatatttcaagttaatatattgagagttctaagaaaactatcacagttgcagcccatttcaggcagtgggtgggctagaggtaacatatagaaatgaaaactgtcatattttggttcctgatacagagttttcatttgctgttcatcacacacagccttatctgggtgaaaagcacaagtaaaagcttgaaatttcacttgatggtacttgatgaaggtttattataaccaactggaatggactaaggtctaattatggttcaaaggtcaaagtaaagtctgatagcatgattgatatatgcagccgaaaagattacagattaagctttttctttctcagtctaccagattattgggttggaaaagatattttttctttgtttgactaattttcagtgttgcagtcatcccttggtatatgcaggggattggttccaggaccaccacccaccccactccacacatactcaagtcccccagtcagccttatggaacctgcttatatattaacagttggccctccttatatacaggtttcttgcatctcccagatgctgtattttttatctgcttttggttgaaagaaatatgcatataagtgaacccatgcagttcaagcccatgttgttcaagtctcaactgtatctagtagtattttttagttgtgaaactgtaaagccataaatgtattaaggaaattacccaaagtcaagcaaccactcataacatctgttcagtcatttttccatctatagtaggtgaatgtttgtatattttatattagcaagtatacactctttcattttcaccttagatattttagttcatttttctgactaaaagcataataattttaaaagttaaaaagcaggccaggcatggtggctcatgcctataatctcagcactttgggaggccaatgtgggaagatcacttgaggccaggagttcaagaccagcctgagcaacataatgagaccccatctctacaaaaaattttaaaattaaccaggcatgatggcatgcacctgtagtcccagctactgaggaggctgaggtgggaggattgcttttgcccagggggacaaggctgcagtgaaccttgattacaccactgcactccatcctgggcaacagagaaagaccttgtctcaaaaaaaaaaaaagtaaacactaaagaagatttagggggaaaagaagagtaactcatctgtatagggtccccccaaattaaaatacacactaaccatcatgatactggttaaacaaatatttattatttataagcaagccgattgtatgtctagaaaaaggaagacagttgacagtgaaaataactgtcttagaaaaagtgcctaataaattgtctatgtacacaacaaatattcacaaattgatatttctcaatataccataaataattagctgttgacactagccataaaaacataatgtttagaaattatatgaaagaaatgtgggtcctgtatgaaaagaattattaaatggagtgagactaagtggtgatttgaataaattgaaatatttgctttaattggatttgaagactgaattgtaaagatattagtatttgatacactcaatagatgttccaaaggtattcagtaataattaaacacctattctcattttttaaaatatatatacttaaagtaaattctagtaggctatattgaggtgatttttttccctgtaaaaaaagcacagaatggttttatacaaccagaggaaatttcattaaaatcaagaccaagacaaatatgttcattatccctagtattatttaatattgctttagaaattatctttactgttaagagatgttaaaaagaaataagttctgtaacttttgaaaaggagaagacaaagttatcattgcttgcagaagatagggatatagtcctggaaaacattagaaacaacataaaatgtcttggtataaatgaattttacaaaaggatagaataaatggtaactatttaaaatatcaatagcttttatgcatatcagaaagccttacatataaaacataatgggagaaatgatgacattcacaataggatctagttttaaaaatgataaaaattgcgaattctgaaagaagatttgaataacaaatggagagacagttttgcagagctaggatgatggtagtggtgactggaatgatgaggaagtcatcacaaagcccctgttgaattacagttttcctaggttccagccatatcacaaggatccctcacaatcatcaggaacagttatgtctcatctatgtgtcattttgtggaataattcaattccacaaccgattatgcccctctaattcagtgtctttgcaagtacctgtatcagagggaaggggaaagaggagaaagacatgctaaaatgggaaaaaagttatgaggtaagccagccttttaatgataatagcaggcaaaaccttatttctagaacacgagggccataacttactgattgaataaaatcccaatcaaaatgccaatggaattttatttgtagagctttacataaccatgttaatattcacgtattagaataactaggaaagaatgcttaatttttaaggaagagtacaatcattttcaaggggatggcattctgatgcctggatttgcaataattattaaatatttcactaatgttgcataagtattatttgctaactgctttgaactttaacccccatcttttagcttcaccaaaaagcagagaaacaaaaacaaccacaaaacttggttttgtaatggaaatttaatctatggtcaaatgagttaatgcttaacattgcctagagtcaaaaggaaagggaagggctgaagtaatccagcattggttgagcatgatctatttgccaggccctgtgttaaacacttcatctcctttaattctgataacatattggtattaatgtcaattatataagagtaaaccaaagattagatagtatttgggattggaattcaagtttttctggctcccgagcctatgctcgcacactaccactgtgccttgtctaaccaattacttcactgagtgctgttgtttgttatggcatttttcagtggtagacagcatttacaacttagatcaggtactcacctgctgaaaaacactatgttctctggaaagcgtttgatggttttgtttgtttgtttgtttgtttttaagactgagtctcactctgttgccaggctggagtacagtggtgtaattgcggctcacagcaacctctgcctcctgggcccaagcgattctcctgcttcagcgtctcgaatagctgggactacaggcgcatgccaccatgctcagctaatttttgtattttttagtagagacaaggtttcaccatattggccaggatggtctcgatctcttgaccttgtgatccacctacctcagcctcccaaagtgctgggattacaggcatgagccactgcacccagtctgctgtgttttttattcttcttctgcatgatatagtaatctcgagctttatcctaatacatatctgcattccagtcacattcccaccagttaatagctgtgtaaccttggacaagctacttaaacatttggagcctcaattccagcagcatacatacaatttcataaagcaacccagaaaagaggatagtccattttgtcattactccatgcaactattttgataaaatctgcaccttcacaatgaattcaatgacgtttatttggggtaatgatattgttgcattgcctctcttgtgcattaaatattgggtgttttttatcacccagcctagggtgaaaagtaaagaaacaaatgtggctcacacttagccacttttaaatcaaaagttcaaataaataaccaagtcaaaagtctgaatacagaaaatttttacttttctatataacaagagagtcacgtatatagaactgttggatataagctatcctgccaaatggaatagcatcatttttcagagggagagattgacaaaaatgtatttgatatactgacaccaagtatatgttaagggcagtgctagttgtggagggcacatagacaaattatatagagtttctaccctcaaggtttttacagtctagttgcggttggggaagaaaaacagacaaatcatgatctttcttgatgatctcttctgtgctataaagaatttttttctctcagtaaggcttcagttagacatcagtgatgctgagaggttaaatgactaagattgtaagtggtggagctgggacttaacgcttaggtatgtttacattaaagctgatctgcttccattcattatggcaacagtttacttatgttatatgtagtgccgtttataattcccagtgagagagtcatcctgtttcccaaatgattcacatctgaaaaatccaggcacacaacatgcccataaaggccagatcacccagtcaaagctcaaataaagtgtgttgaaaccaacaggccagttgtccttattcttgactattttttgtgttaggaaggagcagataggttagaaagtgagagtcacaatattgagcccttctacgaaaagcatatgtttttggctgtgaaggtggcagttacctctatgcttttgctatcttagtggggaccaatcctaagagagcagtttctcaaaaacagctgttatctgggaaaggggaggtgaaaggcctaactcagaaactgagctactcacagctaggcagagcttctcacctcagtttctcttgttggcaggccccagaaacagtttctttaaagacttcagcagatcttttcaagtagatttattgatagaagagccatgagaaatattttggtggctataaataaaaacatatttgcaggttcaagtcaacagacccagaattgaaaactgacttggccactagttagttgttttgtattcattctagagcaattcaagccacattgtattcactcaataaatattcattgattgaatgaatgtgtttattccccccattaggctgtgagacccttgagggtaagagccatatttcattggtctttgtaaatcacatccagttcactgcctaaattctgttaagtatcactgaattttaaattaattattctttggtaagaaacactgatagggaaagcattcgcccaatgtgaacataatacagaagatactattgatgtaggcaccatgtattttgttggttgtataccaagcaaactcttctaatcagctgagagtctgtgagggcaaagatgtctgactcattatctttggtaatgcacagtagctgacatattacagtacatgtaatgatttactgcagcatttcctagagctttttcatttgagtgtcactcagggtttttgctttatctgtgcacagtctgtatgtttatttacttaacatgtttctgtggtatctttgaaataaaaggtatcacttgaaatgaaacgtaactctacgattaaaaactaagaacaaaaaataatgttactaaatatttttaaatgaaattaagattcagtacaagtagtagtaagctactaatgtgtgttgcactaacattttatataccttctctcttttaatcctcatgatagctcttctaaaaaatattttcccattaccacagatgagattaagatctaggtaagttacgtaacagcccagtgtcacacagctagtgtaagggagggccaggactctaaagggagcttgttttttaatgctaaagccaacgtgggatgcagtataggcaatccttaactttattattcccaagtgattccacctggccccttcccctttttcttattgatccagctctccttggttctcagaccacctcctggttacactttaagcagctcttcatcccacaggtcattcccagaccctctggcccactgccaatacacccaacaccaagttctgttagagcagaggaaagatggatatcttttcatctttctgagaacaaaaaacaattgctatctatactttattgagaactattaaggagtgagcatcctgaggaaggctctttgagatctggtttctgggcataagaatgcagatagggacttcagggagagattgaaattgtcctccctgcgcaaaagtctgggggaggagatggagtttggagcctgctgtggggtaagggaggaagggagggagggaaaaagctaagactgagttttggtctgcaggaaatgtgggagacaagggagagcacagggccaggctcatggtgggtacccagtaaatgcccttaagatttaactagagtgaggggtggtaagttgtggggattcacataaagagaaaattgctttccgagttgaaactgtgaccaggacctttccgttttggttcacaaaaatcttttctctgtttttgtaagctgggtagctgaatcaaggaagtttgaggcaggtaatgatttagggcaaggtttggcccaaggaataatggatctgggactggtaactgaagccaagggatagaatacacagtaaaagaaagaggaaaggaactatatgatttattgaaaccagaaccccttttcttcaaagccagctataaagcctaaaaatataactctaactttccctctgcctttctatgtaaaaactggacataaagaagtgatctggcctcctttatttgactgtaggtcataagacccccccattctagagagggaactgccacatacccagaaggaaggaatgctgctcagagaggccaagaagaatctagacagacaggccttgctgagtttcccctcttagtctattcgcattagctcataccctttttgttcaatcatatttctacatggctgttcatactttgttgaacttaaacatagacaaaatggacaatttcctttgtgtctttgggtcttcattctgaaagctcctgtgcatacatgctgaatccatttgtatgccttttctccaattaatctgccttctgtgagttgatttttcagcaaaccctcagagagccaaaggggaagctctcccttaggccctacagcacccactctccactgtgtcaggtaatttatttatattattcattgaaatcttcagagtaactctgtaaggcagatgttgtctctacatgacagatgaggaaataggttcagaatgatgtgaaggaattcagcccaccaaagtgatataaagattattttaaactgaaaatatctgaacagacagcagaagcagaaatgaatattacctaaatttaagcagaacctcctgaaaatacaaccacaattgaacaattgattctgagggagtttcctatttgtattaagactgaccccttagcattgagaagtgcaaatgcagctgccataaacccccccagagggaaatttccagcctaggaaagagataaactgttcattttcattagcatcaaaaaaaccaatagaaccttccatactttcacattgaagccctaacttctcctttgttaaatcgggtatataaatctctctctctctctggcttattgagcaagttactcattattcaatggtcccatgtgcatatggaaataaacattgtctttactcctgttaatgtgtctattgtcagttaatttgaaagcccctgtcatttgactattgaaaccttagatgatagatgatagataaagcagtgtggttccctagaacagcagtcctcaacctttttggcaccagagcctggtttcccagaaaacaatttttccacggggcagggagttgggggagggagaggtggtggggtggcagggtagggggatggcttcgggatgaaactgttccacctcagatggccaggcattagattctcataaggagcacacaaccttaatccctcacatatgcagttcacaatagggttcatgcttctatgagaatctaatgccctgctgatctgacaggaggtgaagctcaggccataatgctctgcaggcccactgcgcacctcctgctgtgtggcctgattcctaacaggctgtggacccatacccatctgtggcccaagggttggggacccctgccctagaataagacccaagagcaaccatagaactgtcccagtacatatccagggttcttaaacctcatataatcatgatccaggccatagctcccaaacttgttgaagctgaagcaaactttgtacgtgggtggacacagaaggaacctgtgtcccttcaaggagtggagtaacagttaagaccagtaagtggtcactttacagaattatcttctgtcctagaatcttctgggcagtcacagatcctggggaaaaggtgacctgagtcaggactattcatcagagcagtcagggcagcctttggattcagggagaccacactgattgaggacaagtcacttaacatccctaaggctcagttctgtaaaatgtggatactcttatctattgccggagatcttgtagggaatggggatgatattagacaagtgtttgccacagcaagttcagcttataatattagcagctcctctgcaacactttttaaaattccaacatactttgtagataactgtatctgcacatataaaacatatccaacacacacacatacatgcatgtagaaaataagaaaaatatttttaaaaattaattcttccattatttgctgttttaagcaagctgcaacatataatattgcacttagaatttacacaacagttatatttctagaattttggcaaaccatggtgctcagatcaactcttcacgtgtaaagcaactcaaaacattatggtaaataacactgggatctagacttttgaggatattttgtctttaatcattaattgttcctataagaaactaagaattgatttttttgttttgttctaattcaaaagccatcagaaagccctggagtcattctaatatttcatgaaaaaggatacttacttggccttttctagaccaactcaaaaaggaggagattagcaagtggcacactgctgatatgcattataaagtgtttctaacaaatatttggcaaatgaatgcttcaagtgttcttattctacaaagtctcttcctgagggttttagcataccataccaactaatgcacaatgtctttctcaaactcttgtttatgatagatttttcttaagaatattaaaatatataatagctatgatttatacagtgttacctatatttgaggaactgactacccaacaaccaaggcagtacaaactgttaaatccacaaaacaacagtggcaatatatgcaattaattactgattttgtatattacgaaagtgaggctcacagagaataagcaactgacccaaggtcacagagtcagtagacagaaaatactagagctggaacatgtgtagtggtgggctagtacaggtttaaaaaccattaagggtggaagatggggcctggaagcacatgctttgtagagtttgctgatttctatggtgtaaatgctccactatagacaattttaaggagtaaatgcacacaattacaagagccagttccagaatgttactacaataggatcctatagtctgaatgtttgtgtccctctccaatttatatgttgaaatctcaactcttaatgtgatggtattaagaggtggagcctttaagaggtgattaggtcacaacagcagagccctcatgaatgggattagtgctgttataacagaggccccagaaagactcctcactccttccatcatatgaggacataagcagaaggtgccatctatgaaccaggaagtggttgctcaccagacactgaatctgctagtaccttgatcatgggcttcccgtcctccagaactatgagaaataaatttctactgtttatacgctacctggtttgtggtattttattttagcatcccaaacaaactaagacataggggaagccattaaccactgagcatcaaaatttcttcactgtgaagtgagaataagaataacttcactgaaaaaaattgctcttaaggcttatgggaataacacaatgtgagagtgcctaatactgtgcctagctcataggtgctcaaagaatgtttgtttagagtcacaatagtaacaaaatagctgctttcaacaataaaacaagatcattactattctccttaactaactcttgaatggaatctactctgtatgagcaacaagtaccatttttaccaacatatttctgtgtggatcattccctaaagatatgtttaaaaactaaatttgcgcagaaaaccacaggctgacaaggttctcagtggcacaacttaactcatagttatccaacctttctaagtcacagctcctactaaacaggtatcatgaaagctacacttcaagtttggtaggatagaagcaaaatctgatggcacatttagcagagtctagtacatggtgcaagtacaatatatggtacttacagactggtataattcacaccctgaagctttcttcaaagcactggaagatggggctgatgccctttttcccccaaggacaccaaacaagatcgagagagattatttacttactagtgggatacagtgtactgaaagagactccacagaccagttgccctgagggtacacatgtagttccaggaatttcatgggtgcttgagatttaaaaagaaaaaaaaaaagctcatacgagtatatttttgcctcagaatatatgatcagtaaaatagatgcattctctgttcatttgtaaaagcttcaagtccatcctgtacaatcagcctattctagagggatgcttcattagcaggcaccaaggtagagtggttatgaccacaggttctgtttcaggccttactcttttataatctatttggaaggaaaatatcttttgctttttgttttattcagactatgtatttcacggccatcttttccaataaatggagacctgtgtttagagttcaaattataagaatgtactctagaaaaggacaccaaatagatgtttagtttatgagctctctttagctttacttgtttccaataacaacctatgcctcagaaggaatcatccttggctttttttttaatttacttgcctgttttgtgcaattgccaagttgcctgtaaagaaattccaattgtgtgtgacacactttatgtatctgcagtataagacctaaagttaaggctcaatattatgtgctgccttgacatctggtgaaatttagagggcttcaaatgacctaaccatgaatctccctccctactctgctcctatgaatgaagtccatagccaaataatggttcttatcaggtggaccaggcatagctcctgcttatccctgagtagccggtttcaattccctgaccgtccatggaattctttaaacaaaccaatcaaatcctcccaggggaaacagggagcactccaccttcttaataccaaatggcctgcttccaacagctcctggttgtccaaatgcaaccacatttggccctgcttggcatgagatgtcttctttcccaggttgtgaatataggtgaaaataaactgttgtcaatgttatttgttccgtattaagtgttatgtgcttggtcaaccccataacgcaagactgggaatactgccctcactgatggaataaatgggacacgatcttactgctgattattaagatcctgtgagataggtatctttattcccatttcaataatgagaaaattaaggttctgaaaatagtagataactgccccccaatcacacagctgagaagcttccaacctgggatttgaactcaatccttttatacttcaaaatctgtgttcatgttagccaacatatctcaaatattgtttaaacactgagaaaattctgtttatcctaaatatgcaacctaataaacttatttttaaaagatcattatttttgagactgagtcttgctgtcatccaagctggagtgcagtggtgagatcttggctcactgcaacctctgcctcctgggttcaagtgattctcctgcctcagcctcccaagtagctgggactataggtacctgctaccacacctggctaatttttgtatttttagtagagatggtgtttcaccatgttgggcaggctggtctcaaactcctgacctcaagtgatccgcctgcctcagcctcccaaagtgctgggattacaggtatgagccaccccgcccggccaaagacatcatttaattaattaatttatttatttatttgagacggagtttcactcttgttgcccaggctggagtgcaatggcacgatctcggctcactgcaacctttgcctcccgggttcaagcgattctcctgcctcagcctaccaagtagctaggattacaggtgcctgccaccacgcccagctaatttttgtatttttaatagagatggggtttcaccatgttggccaatctggtcttgaactcctgacctcaggtggtccacacacgagaacttcatgaagcatacacaagtatcaatagctgaatggtccaagcataagaaaggatatcagagtttgaagaccaccttactgaaataagacatgcagacaagactagagaaaaaagaatgaaaaggaatgaacaaagcctccaagaaatatgggacttcataaaaagaccaaacctatgattgactggagtaacagaaggagacggagagaatggaagcaagctggaaaacacacttcaggatattatccaggagaacttccccaacctagcaagatagaccaacatgcaaattcaggaaatacagaaaacaccattaagatacttcatgagaagatcaatccccaagacacataattatcagattctccaaggtcgaaatgaaggaaaaactcttaagggcagccagagagaaaggccaggtcatctaaaaaagggaagtccatcagactaacagtgaacctctcagcagtaactctacaagccagaaaagattgagggtcaatatttaacattcttaaaaaaaaatttcaacccagaatttcacatccagccaaactaagctccataagcaaagaagaaataaaatcctttccagacaagcaaatgctgagggatttcattaccaccaggtttgccctgcaagagctcctgaaagaagcactaaatatggaaaggaatagttgataccagccactgcaaaaacacaccaaaatataaagaccaatgacactatgaagaaactgcatcaactagtgtgcaaaataaccaaataacagcatgatgacaggatcaaattcacacataacaatactaaccttaaatgtaaatgggctaaatgccccaattaaaagacacagactggcaaattgcatagtcaagatacatcagtgtactatattcaggagacccatttcacttgcaaagacacacatatgctcaaaataaagggatggaggaaaatttaccaaccaaatggaaagcaaaacaaaacaaaaaacaaaaaacaaaaaaaaacctagggtttcaatcctagtttctggcagaacagactgtaaaccagcatagatcaaaaaagacaaagaatggcattacataatggtaaagggaacaattcaacaagaagagttaactattctaagtatatattcacctgatacaagagcacccagattcataaaacaagttcatagagaccaacaaagacacttagattcccaccgaataatagtgggagactttaacaccccactgtcatattagacagatctatgagacagaaaattaacaaggatattcaggacttgaactcagctctggataagtggacctggtagatgcctacaaaactctctacaccaaatcaacagaatatacattcttctcagtgccacatggcacttattctaaaattgaccacataattggaagtaaaacacttttcagcaaatgcaaaagaactgaaatcagtctctcagaccacagtgcaattaaattagaactcaggattaagaaactcactcgaaaccacacaatttcatggaaattgaacaatctgctcctaagtgactcctgggtaactaatgaaattaggacagaaatcaagaagttctttgaaaccaatgagaacaaagagacaacgtaccagaatctctgggacacagctaaagcggtgttaagagagaaatttacagcactaaatgcccacatcagaaagctagaaagatctcaaatcgacaccctaacatcacgattagaagagctagagaggcaagagcaaactaatccaaaagctagcagaagacaagaaataactaagatcaaagaataattgaaggaggtagatatacgaaaaactctctaaaaaatcaacgaatccaggagctgagtttttgaaaaaaataacaaaatagatagaccactagctagactaataagaagagagaaaagaatcaaatagacacaaaaaaaaatgataaagaggatatcaccactaactccacagaaatacaaactaccatcggagaatactataaacaactctacacaaataagttagaaaatctagaagaaacagataaattcctggacacatacaccctaccaagactaaaccaggaagaagttgaatccctgtatagaccaataacaagctctgaaattgaggcagcatttaatagcctaccaaccaaaaaagcccggggccagatggattcacagctgaattctaccagaagtacaaagaggaattggtaccattgcttctgaaactattccaaacaactgaaaaggagagactcctccctaactcattttatgaagccagcataatctgataccaaaaccaggaaaagacacaacaaaaaaagaaaacttcaggccaatatccctgatgaacattgatgtgaaaatccttaataagatactggcaaactgaatccagcagcacataaaaaaacttatccaccacaaacaagttggcttcattcctgggatgcaaggctccttcagcatatgcaaatcaataaatgtaattcatcacataaacagaaccaaagacaaaaaccacatgattatctcaatagatgcagaaaaggcctttgataaaattcaacatttcttcatgttaaaaactctcaataaactaagtattgatggactatatctcaaaataataagagctatttatgacaaacccacagccaatatcatattgaatgagcaaaagctggaagcattccctttgaaaaccagtacaagacaaggatgccgtctctcaccactcctattcaacattgtattggaagttctggcaagggcaatcaggcaagagaaagaaataaagaatattaaaataagaagagaggaaatcaagttgtctctggttgcagatgacatggttttatatatataaaaccccatcatctcagccccaaaactttttgaactgataagcaacttcagcaaactctcaggatacaaaatcaatgtgcaaaaatcacaaacattcatttacaccagtaataggtgagcagagagccaaatcctgaatgaactcctgttcacaactgctacaaagagaataaaatacctaagaatacagctaacaagggacgtgaaggacctcttcaaggagaactacaaaccactgctcaaggaaataagagaggacacaaacaaatggaaaatcattccatcttcattgataggaagaatcaatatcatgaaaatggccatattgcccaaagtaatttatagattcaatgctattcccatcaagctaccattgacattcttcacagaattagaaaaaactattttaaatttcatatggaatcaacaaggtcccatatagccaagatgatcctaagcaaaaagaataaagctggaggcatcacgctgcctgacgtcaaactatactacaagcctacagtaaccaaaacaacatagtgctggtaccaaaatagacatatagacgaatggagcagaacagagatctcagaaataacaccacacatctaccaccatctgatcttcgacaaacctgaccaaaaatagcaatggggaaatgatctcctattcagtaaatagtgctgggaaaactggctagccatatgcagaaaactgaatctggatcccttccttacacattacacaaaaattaattcaagatgtattaaagacttaaatttaaaacctaaaaccataaaaaccctagaagaaaacctaggcaataccattcaggacataggcatgggcaaagacttcatgacaaaaatgacaaaagcaattgcaataaaagccagaattgacaaatgggatctaattaaactaaagagcttctgcacagcaaaagaaactatcaccagagtgaacaggcaacctacagaatgggaaaaacattttgcagtctaccgatctgacaaagagttaatatccagaatttacaaggaacttaaacaaatttacaagaaaaaaaacaaccccatcaaaaagtgggcaaaggatatgaatagacacttctccaaagaagaaatttatgcagcctacaaacatgaaaaaaagctcaacatcactgatcatcagagaaatgcaaatcaaaaccacaacgagataccatctcaggccaacatgacatttaagtcatccctgaattaacatgtcaggaaacaatagatgctggtgatgctgtggagaaatgggaatgtttttacactgttggtgggaatgtaaattagttcaatcattgtggaagacagtatggcaattcctcaaggatttagaaccagaaataccatttgacccagcaatttcattactgagtatatacttaaaggaatataaatcattttactataaagacacatgcacatgtatgtttatggaagcactatttacaatagcaaagacatgggaccaacccaaatgcccatcagtgatagaccagataaagaaaatgtggtaaatatacaccatggagtactatgcagccataaaaaggaatgagctcatgtcctttacagggacatggatgaagctgtaagccatcatcctcagcaaagtaacacaggagcagaaaaccaaccactgcatgttctcactcatagtggcagttgaacattaagaatacatggacacagagaggggacaacacacaccagggcctgttaggaggtggagggcgaggggagggaacttaaaggatgtgtcaataggtgcagcaaaccaccatggcacacatatacctatgtaacaaacctgcacgttctgcatatgtatccagtttttttaagaaattttaaaaatcaaaaaaaactaaaaaataattttaagaaaagacagctgaaaacataattctttctccgtctcacaaaggttgaaaacaaatttccctgtcaaaacgtaactaaaacgtggaaatggttcaagttaaaagctattctaaattaaccagatagtcggctggagaatctggagaaaagtcctagagtaaggagctagtggaaagtcttaaaaggaaattagattataaactttgcagagcctattagtgagaaaagaaaaggtaataaattgtaactattgggataataatccaagtggggggctggctatgcaagtcttatgcacacttaaaataatcatgggattgaatctttgatctgggaatagagtttatcataatatttgtttattatccttataatccctatagggtctgtagtaacatcacacctttcattcctgatattggcatttggtgtcttctctattttgttattggtcagtgtggctagaggtttatccattttatttatcaaagacccagcttttagccaggcatggtggttcccctgtattcccacctacttgggtggctgaggcaggaggatcacttgagcccaagagttcagtgctgtagtgctctaagatctcatctgtgaatagcctttgcattccagcctgggcaacatagcaggaaaaaaaaaaaagaactagtttttggttgtattgattatcaatcaattataataatttctgctctttattatttccttccttctgccttctttgggttaattttgtttcttttttaatagtttctaggtatgatttacttatcataacactcaccaattttaagtgtccaatcaatgatttttagtaaatttacaaagttatgcaagtgtcatcaaaatccaattttagaacatttccaaccctcccccatcattgcagtcaatctccatttctacctccagccccagataatcactgaaatttacaaattttcatttatcaatttgccctttaaggcccctgcatacaaattaaataatacactatgtaatcttctgtgtctggcttctttcattaacataatgtttatgaggttcacctatgtcatagcatgtattggtccttagtttgttttattgctcaatagcattttgtatgactatgctctgtgatgtttagatgtttagatttacagacattagggcaattttcaggttttagctattaagaataatgctgttacataccttcatgaatgggtctttagggaacatatgttttcatttatcttgactaaatttctgggagtacagttatatggtaaatttatgtttagccatttaagaaattgccaaactgtttttccaaagtggctccatcattttacattcccactcgcaatgcctaagggttccagtttctccacatgctcataaacactccttattgtttgtcactttgattacagtcattctaatggtgtgaaatggtttagatttgcatttccctaataaataaagatgagcttcttttatatgctttttggatgtagtatttgtacatcttcattgttaaaattttattacagtgttttgatcatttttaattggtttatttgaccttttgctatttagttgtaagaattgttcatatgtttgggatacaaacccttattagatatggtttgcatgtattttcactagtatgggacttgtctcttcttttttcttcatggtcttttgatgtttggaagtatggggtagatgaagcacaacatatcatttttctcttttgtagattgtgtttttagtgttgtatgcaagatatctttatctaaccttaggtcatgaagatttgattctaccttttcttctaaaagcattatagttttagctattacatttagagatacaatctgttgagagttaattttttgtgtagtgtgaggtgaatgtctaaagtggtctttttccaagtgcatgttcaactgtccagcactgtttgttgagaaggctactctttatcccagtgaattgctttggcttctttgtttaaaaaatcaattaatcataaatataaggggttatttctgaactttcaaatatattccattgaactatatgtctgtccttatgccagttaatacagtgttttgattactgtagatgtataaaagttttaaaactgtgtagtagaaaccctccaacaattttttctttttaaagattgatttgccaattctagatcttttgctttccatatttttaattggatagtcactttctacaaaaagtcctgctggaactttgatggggattgtgttgaatccatagaccaatttggggaaaattgccaaacagcatcgtgtcttggaatccatgaatatagaaagtctttctaataatttagatcttctttaattcattgcaatgttttacaatgttcaatgtgcaagtcttgcacttcttttggtaaatttagtcctaaatatttttctcttatgctgttgtgaatggccttcttttccaaaaactcatttttgcttgttcattcgtaatatatagaaatacaactgatcttttatcctgcaactttgctaaatgtagctattagttctaatatttctgtgtgtgtgtcttaacattttcttcatcaagattatgttgtcaacaaataaagtcagtttaacatcttcctttgtaatccagataccctttatttgcttttcctgccttctttcactggatagcacctctaatacaatgtggaatagaattggtgagagctgctattcttgtcttgttcctgatcattgagggaaaccattcagatttttaccattaattatgatgttaacagtaggtttctcatagatgctctttatcaggttgaaaaacatcccttttgttactattttattcagagtatttcttatgaatgaatgttggatttttgtcaaatgctttttatgtatctaccaagatattcaggtagattttgttctttattaatataatgcattatgttaattaattttttaatgataaaccaaccttacatccctggtacaaatctcagttgttcatggcacataatcccttttaaatattgctggatttcacttactaatttttttatttacttttaaatctatattcataagaagtatttgttgttttcttgtaatgtatttctctggttttggtgtcagggtaattttgacatcatagaatcagttgagaagtgtttcctcttctattctctgaaagattatgtaaaaaaatctttacttatttaaatgtttggtagaattaagcagtgaaactacctggtcctgtacttttctttgtgggaaggtattttaattactactttctttgatttcttcacttgtttattctgattttctatttctattttctctttctttcttttttttttttttgatgcagtctccctctgtcacacagggtggagtgcagtggcacaatctcagctcactgcaacctccgcctcctgggttcaagtgattcttctgcctcagcctcctgagtagctgggactacaggcacgcaccaacatgcccagctaatttttgtacttttagtagaggcagggtttcaccatattggccaggctggtctcgaactcctgaccttgtgaactgcccaccttggcctcccaaagtgctgggattacaggcgtgagccaccgtgcccagcctattttctatttctttctaagtcactttcagcaatttgtgtcttcctaggaatgtgtccatttcatacattttaaaatttgttgccataaagattatcatagtagcctctataatcctttaatttctctaaggtcaatattgatgtacccacttccatttctgattctggtcctttgcatctcttccctttatttcttggtcaatccagctaaaatattgttaatttttttttttttttgagacggagtctcgctctgttgcccaggctggagtgcagtggcgcgatcttggctcactgcaagctccgcctcccgggttcatgccattctcctgcctcagcctccagagtagctgggactacaggcgcctgccaccacgcccagctaaatttttttgtatttttagtagagacggggtttcaccgtgttagccaggatagtctcgatctcctgacctcatgatccgcccacctcgacctcccaaagtgctgggattacaggcgtgaaccaccgcacccggcctaaaagattgttaatttttaaaaaatactttcaaagaagaaacatacagtttcactgatttttgttatggcttttttttttctaattcattgatttccagtttaatctttgttatttccttttttcacttgctttgcattaaatttgctctgactctttctagtttactcagttgaaagcttcaattactgatttcaaaactttttccttttctaatacgagcatttattgccttcatcgttcctctaatccttactttaatggcactgcaaagttttattttaatggtaacatcttgcaaaactataataaaagttcaaaataacaatattgatattgacattgatgcaatccatgcatcttattcatatttccccagcttgtttgtactcatttgtttgtgtatgtttgtgcattggcttctttttttgttttgtttttttctctgtcccccaggctggagtgcagtggtgccatctcagctcactgcaacctctggctcccaggttcaagtgattctcctgcctcagcctcctgagtagctgggattacaggcactcgccaccacgcctggctaatttttgtattaaaatttaatacaaatttttaatagtggagatagggttttaccatgttggccaggctggtctcgaactcctgacctcaagggattcgcctgcctccgcctcccaaagtgctgggattacaggtgtgagccactgcacctggcctgtgcatttggttctatatatttttatgacatgtgtagattcataagttcatatatttactatcagagtcaagatacagaacagatcccagcagtgccctttcataaccacactaacctcctccccatccctgcatcagccctaagcactagcaactacacatctgtcctccacatctgtaatctttcatttcatgaatgttatatacattgaaaactacactatgtaatcttttttttattatactttaagttctagggtacatgtgcacaacctgcaggtttgttacatatgtatacatgtgccatgctggtgtgctgcacccattaactcgtcatttacattaggtatatctcctaatgctatccctccccccttcccccactccacgacaggccctggtgtgtgatattccccttcctgtgtccaagtgttcccattgttcaattcccacctatgagtgagaaaatgcagtgtttggttttttgtccttgcgatactttgctcagaatgatggtttccagcttcatccatgtccctacaaaggacatgaactcatcattttttatggctgcatagtattccatggtgtatatatgccatattttcttaatccagtctatcactgatggacatttgggttggttccaagtctttgctattgtgaatagtgctgcaataaacatacgtgtgcatatgtctttatagcagcatgacttataatcgtttaggtatatacccagtaatgggatggctgggtcaaatggtatttctagttctagatccgtgaggaatcaccacactgtcttccacgtggttgaactagtttccagtcccaccaacagtgtaaaagtgttcctatttctccacatcctttccagcacctgttgtttcctgactttttaatgatcaccgttctaactggtgtgagattgtatctcattatggttttgatttgcatttccctgatggccagtgatgatgagcattttttcatgtgtctgttggctgcataaatgtcttcttttgagaagtgtctgttcatatcctttgcccactttttgatggggttgtttgtttttttcttgcaagtttgtttgagttctttgtagattctggatattagccctttgtcagatgagtagattgcaaaaattttctcccattctgtaggttgcctgttcactctgatggtggtttcttttgctgtgcagaagctctgtaatttaattagatcccatttgtcaattttgtcttttgttgccattgcttttggtgttttagacatgaagtccttgcccatgcctgtcctgaatggtgttgcctaggttttcttgtagggtttttatggttttaggtctaacatgtaagtctttcatccatcttgaattaatttttgtgtaaggtgtaaggaagggatccagtttcagctttctacatatggctagccagtttttccagcaccatttattaaatagggaatcatttccccattgcttgtttttgtcaggtttgtcaaagatcagatggttgtagatgtgtggtattatttctgagggctctgttctgtttcattggtctatatctctgttttggtaccagtaccatgctgttttggttactgtagccttgtaaaatagtttgaagtcaggtagcatgatgcctccagctttgttcttttagcttaggaccgacttggcaatgcgtgctcttttttggttccatatgaacttgaaagtagttttttccaatttggtgaagaaagtcattggtagcttgatggggatggcattgaatctataaattaccttgggcagtatggccattttcacgatattgagtcttcctatccatgagcatggaatgttcttccgtttgtttgtgtcctcttttatttctttgagcagtggtttgtagttctccttgaagagcaaatgcaccaattttgctaaagacacaatctaccaaaactcacttaagaagaaatagaaaacataaataatcctacacctattaaagcaatgaaatcaataattaataaccatctggaatgaagtttctaatcatcttcccaaatcaaagtgcagcaagcccagaggggttcactggtgaatttaacctaacattaaagggaaaaaattatgccaattttctataatcttctctttaaaatagaagcaaagtgaatacttcctcactcattctagagtccaacattaccctaatactaaaatgaaggatgttacaagaaatggaaatacaggccaatatccagtctgaacatagatgcaaaaatcctcaataaaatattagtgaatcgactccaataatatttaaaaataattatacacccataaccaagtgggatttattccaggtatgcaaggctgggccaacattcgcaaatcaattgatgtgatccatcacattgagaggctaaagaaaaaaaggatttgatcatataaatagatggagaataagcattggacaaaatctaagaccaactagcaatagaaacacccagcaaactaagcatagaggtgaacttcctcaccgtggaaaagaatatctacacacaaaaaatctacagttagcattatagttaatcacaaggaactagatgttttccccctaagatcaagaacaaaacaaggatatccactatcactactttttcaaatttttattggaaaattttgccaatgcaataagacaagaaaaggaaataaaagttatacaaattgggaaggaagaaatcaaactgtttgcagatgacataattgtgtatgttgaaaattctcaagaagcaataaaataagtcttggaactaataagcaattatagcaaggtcacgggatacaattataatatacataagtccattgctttcttatatacccacaatgaaatatttgaatttgaaatttaaaatacaataccatttacattttcagtaaaaaataagtataaatctaccaaaatatgtagaggatatatataaagaaaatgacaaaacactggtgaaataattcaaagaagaactaaacagatggggaaatactccatgtaaataaataggaagacacaatattgttgagcaatcaagttcttcccaacttgatctatagattcagtgcaattccaatcaaaatcacagttagttattttgtcaatattaacaaactgattctaaagtttacatagaaagacaaaaaatcagaatagctatgaaagtattgaaggagaacaaaattggaggactcaccttacccgacttcaaaacttactataaagctacaggagccaagatagtttagtattggcaaaataataagcaaatagttcaagagaatagaataaagagcctagaaatagactcatacaaatatagataacccatcttttacaaaagaagaaaggcaattcaatggagaaaggacagacttctcaacaaatgaactgcttgcatgcagttctacatgcacaaaaaaagaatctggatatagatcttacatcttttatcaaaagtaacccatgtaattgttaatatgtaaaacacaaaattataaaacttctagaagctggcaggggagaaaatcttggtgacattgggtttgactattatattttgggtataataccaaaattacaatctctgaaagaaaaaattgatttcaggctttactgaaaataaaggctgctctacaaaacacactcttaatgactaggctgggagaaagtctttgcaaaacacataaccaataaagaactagtatccaaaatatacaaacagctcctaaaactcaacaataaaaaactaaacaaccaacttaaaaatgggcaaaatataggaacagatacctcaccaaacaaaatgtgcagatagcacataagcatataaaaagatgctcaatgacatatgtctttagggaattgcaaattgaaacgatgataaaaagccattataaacttatcagaataactaaaattcaaaacactgtcaaatgcttgatgtggagtgatggaaactctcattcattgctggtgggaaggaaaaatggtacagctactttagaattcaatttggcaatttcttagaaaatcacacgtattcataccatatgatccagcaattgaacttccaaatgagatgaaaattatatttacacaaaaacttgtacacaaatatttgtatcagttttattcataattgccaaaacttggaagtggcctgtcttagtctattttctgctgtttatacatagtacctggacctgggtaatttatatgaaaagtaatttatttcttacagttatggaggctgagaagtccagggtcaaggggtcacatctggtgagggccttcttactggtgggtactctgcagagtcctgaggaaaggcagagcatcatatggtgagaagctaagcaggctagctgtgatctctcttcctcttcttataaagccaccagtcccattcccatgtcaaaggccttttctacatctattgagataatcatgtgttttttgtctttggttctgtttatatgctggattaagtttattgatttgcgtgtgttgaaccagccttgcatcccaggggtgaagcccacttgatcatggtggaaaagctttttgatgtgctgctggatttggtttgtcagtattttattgaggatttttgcattgatgttcatcagagatattggtctaaaattctctttttttgttgtgcctctgcctagctttggtatcaggatgatgctgacctcataaaatgagttagggaggattccctctttttctattgattggaatagtttcagaaggaatggtaccagttcctccttgtacctctggtagaattcggctgtgaatctgtctggtcctggactttttttggttggtaagctattaattattgcctcaatttcagagcctgttattggtctattcagagattcaacttcttcctggtttagtcttgggagggtgtatgtgtccaggaatgtatccatttcttctagattttctagtttatttgcgtagaggtgtttatagtattctctgatggtagtttgtatttctgtgggatcggtggtgatatctcctttatcattttttattgcatctattggattcttctctcttttcttctttattagtcttgctagtggtctgtcaattttgttgatcttttcaaaaaaccagctcctggattcattgattttttgaagggtttttttgtgtctgtatctccttcagctctgctctgatcttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacctagtagtcattcaggagcaggttcttcagtttccatgtagttgggcagttttgagtgagtttcttaatcctgagttgtagtttgattgcactgtggtctgagagacagtttgttataatttctgttcttttacatttgctgaggagtgctttacttccaactatgtggtcagttttggaataagtgtgacgtagtgctgagaagaatgtatattctgttgatttggggtggagagttctgtagatgtctattaggtccacttggtgcagaacactatgtgatcttttgggattaacttcttacattcagcataattctcaagtaattgtgtctatcaatagtatactcatttttattgttccattttatttcgtggtttggctaacttagaagtatgactggtttatattcagttgagagctattatgagtaaaatttctatgaacagtcatgtagaggcttttatgtgaacattcttccatttctctggcatatgcctaatagtgaaattgctgaattatttagtaattggctgtctagttttataagaaactgagttttccagaatggttgtatgatttaacaaccctacaagtcatctatctttgattcagtttctctgcatctttgccaatatgctgtatgtcctcttctgtgaaatatctgttcatgtttttaacattttcaaatttgactgtttaatactgctgagttttgagagttcttaatattttctgaattttagtcatttgtctgatttgttgtttacatatattttctactatgttttaatgttccttatatgtctgataattgttcttgttccagaatttgctttgtctgatattattgtagccactctagctctctttcttttgattagattttgcatagtatatgttctttatcctttatttttaacctatctgcaccatgatatttaaagaggatttcttgtaaatagagtacagttgagtgttcttttctttacctaaactattttttaattggtgtactttgaccacttacatttattatagttactgatatgttggatttggctccactgctttattgtatgcttcttgttgctgttttccccctccatttatttgtttttctgttcaactttttctttcttattttagattatttgaatattttaatatgttattctatttatctctttgctttgtaattatctctctgtattacattttaagtggttattctaggggttttatatatatatactttacttttcagaatctactttagttaatgctataagtaaaatcatcccttttatagtgtagttgtcatatgcattatatctacatactttaataatcccatcagtcaatgttataagttttactttctacagtcaaacatatttttaaacttaagagaaataaatagtctatttatccagacatttaccatttctttttatttttctttatgctgaagttcagtttccctctcttaccatgctccttcagtctaaaaatcttcctttaacatttactttagcctagagttttcagcaacaaactctattagtgttcctttcatctgagaatgttactgtttcgttgtcattacttaagcatatatacatattgctgcacgtagaattccagattgacagttattatctttttcttcaacttttcttcaattttttcttcaacttttattctgagttccagggtacatgtgcaggatgtgcaggtttgttacataggtaaacaagtgctatgatggtttgctgcacctatcaagccatcacctaggtattaagcccagcatccattagctattcttcctgatgctgtccctccccccaagccccgactggccccagtgtgtgttgttctcctccgtgtgtccatgtgtcctcatcattcagctctcacttatagatgagaacatgcggtgtttggttttctgttcttatgttagtttgctgaggataacggcttccagctccatctatgtccctgcaaaggacatgatacagttcattttatggctacatggtattccatggtgtctatgtaccacattttctttatccagtcgatcattgatggacatttgggttgattccatgttttgctattgtgaatagtgctgcgatgaacatacacgtacatgaatctttatcatagaatgatttatatacctttgggtatataccatagggattgctggtcaaatggacttctgcttctagatctttgaggaattaccacactttgaggaattatcacactgtagtgtgaggaattaccacactacaatggttgaactaatttacactcccaataacagtgtgaaagggttcctttttctctgcaacctcaccagcatctgttgtttgttgactttttaataatcaccattctgactgacgtaagatggtatctcattgcgattttgatttgcatttctctagtgatcagtgatgttgagctttttttcttatgtttgttggccgcatgaatgtcttcttttgagaagtgtcttttcatgtcttttgcccactttttaatggaattgtttggtttttctttttgtaaatttgttgaaattccttgcagtctctgaatattagacctgtgtcagatgtatagtttgcaaaaattttctccctttctgtaggttgtctgttcatgctgttgatagattcttttgctgtgcagaaactctagttaaattagatcccatttgtcaatttttgcttttgttgcaattactttgggcattttcgtcaagaaatctttgcctttgcctatgtcctgaatgatgttgtctaggttttcttctagggtttttatagctttgggtttcacatttaagtctttcatccatcttgatttttgtataaggtgtaaggaaggggttcagtttcaactttctgcatatggttagccagttctctcaggactatttattaaacagagaatcctttccccattgcttgtttttcacattgacagttattttctttcagcactttaaaaatgctgctccaccaccttctggcctacatggtttctaaagtgtagcacacagctatttgaatcgttttccctttgtatgcattgtattactttttactggccattttcaaggttttactctatctttggtttttagaagtttgattatgatttttctgggcacaatttgctttgagtttataatttttgagattagatgagcctcttgaatctgtaattttgtctttcccctaattcaagaagtttcagcaattatttcttcaaatatattttctacaccaatatcttttttctctccttttgggagtgcaatgaatatgacaatttctgagttgctgcttattttatatcaatatttttactctgtgttcatgagattgcataatttctatttatctaattttaagtcactgaccctatatttatcattgcccattcttccattgagctcatccagtgaattttaaaatttcacatgctgtgtgtttcatttataaaatttctatttggctttgttaaaaattatatttctctgctcagaatttctatatttcatgtcagcagcatttatccttactataccttcaccccatggaacatggccataatgattttacagcttttaaaaaatatttggcacttcccagatgacaaatctgggtcatcttagggttggcatatgttgtctttttttatattggtttttcaaatttttcttgatatttagtatattcttgatatttagtataagtttaggttatattcttggcattttgcataatatcttgttagaatctgagtcctattaatatcctctggagagtgctgaatttttttgggttggacttagctagaccaacatggctagattcagactaaatgttctgtctcgctttctttgaattattattccattttcagttcagtttgcaaagaaattgctattctgctttggctgtcccatagacacacctctcagtatttagtttgagacttgagtggcgctttatgaaatagaaacttcaaaatactttactatgctgctttgggtaaattctgtgaatgcacgacttaacagaaagcctgaaatttatgcatattccttcacagcattaggagattcccctctcaagctctttcctctttaagattctccctctccggccaggcgtggtggctcacgcctgtaatcccagtacgttgggaggctgaggtgggtggatcatgaggtcaggagttcgagaccagactgaccaacatggtgataccccgtctctactaaaaatacaaaaattagccaggcatggtggtgcacgcctgtaatcccagctactcaggaagctgaggcaggagaatcgcttgaacccaggaggcggaggttgcagtgagctgagattacactactgcactcaagcctgggtgacagagcaagactccgtctcaaaaaaaaaaaattcatcttcatattctctggtttccaggagccccttttaccaatcctctgtccagaaagataagatttcttttggatttttaatcactcatgacactagaggtgaactctgtggttctaagttctctctagctgtgaatggcacagaactttcaggtaaaacatccacctcctctttcccaggtaacagctgtttctgaggagctctctttctgagggatataccccattcgatgagtaggacacatggaacagctctgcttcccaagtgttttaactctgtcaggtactcaattctctcttatagtgtctctcatttattgatcaggctgcatactccatccttaccaacggaaatttggaaagataaaacccaattttgttggtttcagagatcttcttagctttaatgaagaatactttgcagagatgctatgccctgtgaggtgcttgtatttttcagcaaaaattgtattggaggtagatgattatctcaggaataaatatatctattaatatatatcagcaactctaacatgattaaattattgtcgtcactcaaacctgaatctttatatacataaagtggaatggaaaatggtccactgcactgaaattaactacatgacaaaaaatggtgcttagcagcataatgaaatattttctcacttttaaataattttaaaaaatacatatttaactttctcaatataaaaagctaatttgaaaaataatctccttatacaagtctatagcagatagctcctcctccttcctgtgattctcttgggggtaacatgacttctttcccagtatctaagtccttgagctagaattttaaaacaattttaagcattgtgacatctcctcaccctccattcttcacaatagcttccttgagaataatgctgatgaccactactttttgatacattgcatttaaaatctttatctgtttctcttttactggaacaaagtcatgaaagcttgctttctaaacaaaataatctcttgtatccaaagggaaaaatgcaaaccgaaatcagtagttaggcataaaatgtacttttaaagaacaatgttggctgggggcggtggctcatgcctgtaatcccagcactttgggaggccaagatgggtgaatcacctgaagtcagttcaagaccagcctggccaacattgggaaacgttgtccctactaaaactacaaaaattggccgggagtggttgtaggcacctgtaatcccagctactcgggaggctgagacaggagaatcacttgaactcgagaggcagaggctgcagtgagccaagattgtgccactgcactccagcctgggtgacagagcaagactccatctcaaaaaaaaaaaaaaatgctgtcctgtttcccagtacctacccccacttcactgaacttggaatccaaggttcactacttttccaagtattagactggagtgtggaaatgttattgaaaaaatgtgtaactaccagacagatccaggccagaaacccagaaatatttttttttaatttaaccgtgtgcattcattttaggcagactaggtggacacacataggtatgcacacagacatacacatggtacagtaagagggtctcataaaacttcaaggtacagtaagagggtctcataaaaattcaacgctggaaatagttgtttccaatccggaaggcactgtgccaagcaaacagggatgtctgaaacctttgaacactgattttaaaccaattgactctgaattgatttacacagaaatattgacacaaacacttattgaatacttaagatatgccagcactattttaagtgttatgcactgacttaattctgacagcaatcttttttttttttttctgggacggagtctcactctcgcccaggctggagtgcaacggcctgatctcggctcactgcaacctctgcctcccgggttcaagcgattctcccgccttagcctccaagtagctgggattacaggcatgcaccaccacgcctggctaatttttgtatttttagtggagacggggtttcgccatgttggccaggctggtctctaacacctgacctcaagtgatccgcccgcctcggcctcccaaagtgctggtattacaggcgtcagccaccgtgcccagcctctcacagcaaccttatgttaaaagaaagacttcagctgaattcaatttaaaggagtttaattgagcaatgaatgattcgcaaatcaggcagtccccagaatcacagcagattcagagagactccagcgcagccacatggtggaagaagatttatagcaaaaaaaagggaagtgtcatacagaaatcggaagtgaagtacagaaacaactggattggttacagctccgcgtttgccttaattgaacacaatttgaacacttagcagtctataagcagttgaagtatggctgctgggatttgccaagactcagctattgttacagggcatactcctaacttaggttttcaatcttgtctacctattaagttaggttacagtttgtccacaaggactcaaatttagaagtatggagtccttctcaggccatatttagttcgtttcaacacttataatgcaggtactattattttctaaatatcacgcttgaggaaaccaagggacctcggtcaacttaaacagctagtaaatggtggtgctgagatttgaatccaggcataggtatggccctagtacccattattttaacccagtacagtacactattgcctctccatttgtgaaaagaaaaaaaaaaagacggaaagtcctttttatatggaaatacagataggattttaaaaacaggccccagaaaaccttacacaacactttctgctattaaaccattctctttccttcttccccttctctctccttcccttttccctctccagtccatcaaatccttgctatggaatatcacgcactcctaaatccaactgctcctttgacattctttggccacaaccttaaaataaatggccaccctaggatagatggggttaaaaccacaaaaaaagagtcttcttggcatgctagagtggctgcagtctaggaggctttctggaaaatggaggtgattctccagaaaatggaggtttgtttttctggaaacaaaatgtcatggttgtcaggttactgataaggggactattaggaaaattgggtcccaaatttattcgtaaggcaagtaggggtgcaggacgtgaaaagaaggtgggtttccctgtatgctgggtgtaatggcctaattatttctactacatgcaaaatacaacactgcttcttgggttcctcaaaatactcaggccctgggcactgaatagtgtgtgcacggatgagggctgtcccccttagagtgatgattggtaatgataggtgattcatgaaaaaaaaaaagtacagaaggttacagggcagaggatggcaaagggacaggttggagaatctgttttttttaaaaagttatctggttggtggtcaaggactggaggtggagaagagtggaggggttgaagaggattgtcttctctgtgaaaagggttttataggttatttctagtatagcacactcttgtgggaataaatgttcatttgaatttttgtgaaattctaaaaatagtttctaacattcacttggtaaagaattcagtaactttccaagtgaatatgtatattgatcaataggttcccaatccatttttacctaaatggtagcacactgtacaaactactctgtaccttgctcttttgaattagcactgtaaccatagacaaccagaaaaaaacctaagtatttatcaaagtgggcaatggttaaaagaattattctatatccatgaaattgagtatcatggagatattagaaatggtgatgcaatcatatattgacattaaaattatattcatcttctaaggtcaaatgagaaaagcagcttttgaaacagagatgtgtgtgtacacatgcaaatgcatagttagaagtttagagagatataaacacacaaaaattgttgactgaacatctctgaatgatggcattacagatgatatgtttccctattttatgtgcattttgtaatgtttgggatttgctaccatttggttcattacatatttaatttttaattatgtaatactttcacagaattttttaaaatcagcaaataacaaaaggtatagattaaaaagtccccatcctgtcccaggatcctgcatccctagctccctagttcccattcctagattaggaaattcaacattcaaatgaataaaacaagtttctcatgatatagtgtatatatggagaggcagggatgctgtattagcaaataagctcaatatattattgccacggctaggagagaaatctgttcttcgtgtgaaccaagctctctctgacttgttcaggtcctcagatatactgttccaactaactggaaaacttgcccttccctttacacctggctgtctttttactgttccaactaactggaaaacttgcccttccctttacacctggctgtctttttactgttccttcaagtctcagctgataaatctcttcctccaagaggccagcgtaaactagcagggatttccatcctgtgctgtctcaaagcactctgtatttcttgtatctcagaaagcacatataccctttgctgtagcttcttttttcttttctgtctcttagcaaacagcacaaacccagcatgaagcttgttcatttttgcatcttagaatctaacatgatacccagccagcaggtttgggaaaatctatctcatttgggtcacaaagaccaatacaaaaactttgttcccatcatttcctcatcatccaacatatgttagagctgtttgaaaggcataaataaaggagttgactttttggtggatggaaaatggtaaaagtttattactaatatctgaagtggaccaagatgttactcaggcttaaaaaatgtaattagaaatagaatttgagggcaggagacttctggaaatggtttccttactcttaaaaagagacatacagggctgggagcagtggctcacacctgtaataccagcactttgggaggctgaggcgggtagatcacgaggtcagtagttcgagaccagcctggccaagatggtgaaacccgtctctactaaaaatacaaaaattagctgggcatggtggcaggcgcctgtaatcccagctactcgggaggctgaggcaggagaattgcttgaacccaggaggtggaggttgcagtgagccaagatcgtgccactgcactccagcctaggcaacagagcaagactccatctcaaaaaaaaaaaaaaaaaaagacatacaggtgaaaacgacctttttcttttcttttctttttctaattaagaaaacacattggtttttctattactcaaggtttaatcaaataaacaaaaccagcaggagatatacatatacacacacatacacattcaagtgactggcttacataattgtgggggctggctatataagtccaaagtccatagaatagtcagtcaggaagtaaagatcacgagtaggctagagtctcctcaggtatgggatgaagcggtttctacaagtacaagcgtctcttttcccaaggaaggcctaagcccctttttagggccttctaaccgattaagtcaggcccacccaggacaattcctctaactcaaagtcaactgattagggtattctagtacatctggaaaatccctttgcagcagaagctatatttgtgtttaaataactgggagtagtgtgtatgccatagaatggctgctacttcccttccatcttctaattcacacaagagattatctctagtagcccacttatcaagaaacataatagaaagttaattctggggaatgtaattttgcctacccaagttgacacaccacagagttattatatcctctatagaatgcaccatccaggacttttcccagaacttgatgagaggtagacttgttttgggagatgagcaaaggaattatgaaagtttatttcttctttgtttcaggcagtcttctttttatactggaagcagttgtgcctagaattgatgcctggaagtcttattgcagagaaagcattctaaccgaagtgttttttgatgtcagagggctcatttcctggaattcctagagacagaaatcttctgacttcaagaaacccagacaccctgaagagaagtcagccaagacgcgggcttcccaaataacctacccagaatggtacagttgcctccaatacccactggaggtcacaacttcactgctgatatcatcagctgttgtccagtgggaatagaagtgaatcctttacaacctattttaagtcctcatagcacaaagtatatcaatataaaataggtccaggacttagttgtgtggtcaaaagggataagatagaaaggacaatgatccttcccgcatgatctatactggactgaaaccccagtggctaccggcatactgatgtgaatagctcttcttgaagcatggcaggtatgcttgggtgcccaagattcctgtccaggcagagcagtaagagtagtgttaaaccttagggcctcgttgcaattggattgattgaacccaagctgtagcagcaatagtttatttatgtccacttatgaactcttgtccttcagagaaaatgcaggatttcattgctcccggagggtgagtttggaaatctgcaattgcactatttttaggcagaacagaggagtttctgtttatttttggttaattactaatacttcatattgcctctacagcccctcccccatccatttcctcagacatggaaattttgctctctctgaaccctttctgtgagcgctgtaataccaaaagccagcactaaaatatagggatcctccttagaatacagcaggaaaagaaaacaatttctttctcatttctcaaaaggagacatatattagttttatcatatagtggtaatcagctatagcacctctgctattttgtagtttttaaagaattttacaactatttgtttttcattgtatttatttttagttataatctatgatatgaaacattagttttccattcttgatcatgatgtggggcttcttttaaactgtatttaaatttaaagtttatatggtttcaatggaaatattaatcgaatgattattcaggtggtatttggatatgttaaaaatcctaaagatggtacgtgaatgaccaagatctgggaaaagcaactttgattcactgtgacagataccatatgcaatgtctcagtaaaaggagtcaaagttcttcttcctcagtacctcataactcaccacaagagttaatctggtacctgatacacaaagctacacattggtactaatagtggtggcacttgtttttctcattccagattgggttagggagcttgttttcctatcagtgtcactactaaggttaattaattaattcaacaaatagtcagtatgcctattaggtttcaaccagtgacctgtatgccggatctgtaaataccaaggaaatatggcctttgtcctatctacagaaacaggggagcacaaagaagggacatagagaaacaggagagaagcgaaatagacagagaagatgtggctacagaagttggaggaaaactatcagaactatctcttgtgaatacaagagtgcttacctgtacttgacaattccactgatacctgggttcacaccatcaaatatatctatgtaagcctgaatgatgcttataccttttacttataaaataaaatattctaattagcatgcctatatacatccattaccctgcatgtgggaagcaatcagtgaattattcagttcaatctcgtcaggaggaaaatcacactaacagatacactcagatacattaagaaatcaagaattcaagaatatactggctctggaaattatgagaagtatggggttgaaagacatagacccttctcttagtgaagaaaattggagttgaaagatgtcctgtagtcacttgtttaaaagatattattaccaactaacatataatcagtacaataacatctaaactttattgtaaactctgtgtagaatgttccatattcttcacagaataaatgtttactgaagaccttcagggcactagtttccaggtactgtgagtacacatgatgattcaagtttggtcccaggctcaaagaacccacagtctaatggacacagataattacagtactgatgtgtgggaagcaggaaagctacaagagcaggggatgttgggaaaacagaggtgggcccctttaatccatgtggtctcagtagggggcttctttagtaggtaggtactattattatctccatttgtctgatgagaaattaacagagagaatagtacctggtatatggcaagcactcaatacacattcctttaaggaataagtggatgttaagcaacttgctcaagaaaacacagctagttagcgctggagtttttcagccccaaatctgactgcctcaaagccctgtgctgcttccagtatgctgatctctctctttgccagtaatgtcactcatactgtggagagctactctccctctgaggattcaacctgccatagagagcagtgagagaaggggcaggtacagtttccaagcctttcacattggatgaggcaccgaacttccagagaagatgcttctgatgtcactgtcattttctgagctgtctggtctttctacactcattaaaaagttaggaaggtgtactgcatgcgtcttggcttcaggaaaactccttttagtgctgacttagaggctcctgtcacattataagggtgctgggtcctgctgaatttttagattgtccgggagaaaatggttttcccaggaagatggctatcttatcaggaatgccatgtcctgctctgcagcactgtggaaaggatgccataatcgaaaactaaggtattatctcaggctgtgaaatgtaacatgtgtaattataaacaagattgttaactgtttgcttacctgttctgccctccttgaaatgaaattgtccagtccaggtctaacttcaaagccttttctcttttctgaaagtaagagcttccaaaagtgtggaacacagaaaactggtgatgttcataataattttagtgctacttggacattaaaattttaatagttgtatatgtgttttacttttcagtaaacatgtagtatatcacagccacatcaagatctttgtgtggtgattggggaagagcattgatattacacactccatggaaaatcaccataacatttcctttcaagatctctgatctttccctcagatttcctaccctgttggcaattgcgcagttttttctcactgtttaaatctttcatccattatcagacttcttgtttccccaagaatagaagccatccttctgtcctccccttctgtcatctgtttttacagaagcagaatctaaggttgtgatttgcattctttcaaccaggaaccatttctgcaataaaggaccctcctcagaacacaatctttggctgacagcaagatattgtaaacgatgaattttttctctctcagaaagcatacaaacaaatttccccacccctaaaagacagaaattataactgcatttcaggaagaaaaaaacaccatacctcatctcattgggtgtcctgagcattttgccacaggatctagggagaggtctcagggatgagaagttggctgatagtgttgagatcataaattccataaagtgtgtcggagagaatgttggtggataattaagctgacaacggcctacactgcttactcagcagtctgtgggctttggcatcatatgactgtgggtgtccatcctaaatctgtggcatagcagatttgggcatcttttctaacttctctggtctcagttttctcatcttgaaaaatggaaatggtattatgcattctgagttgctttatgaggattggatgagataatacatatgaagtgtttagtagtatagaaatctattatttatttcatttttatttcattttaataaaaagggtgaagaataaaatatttaattgaaataaattgatttaagtaatttaaggaaatttttcaataaaaaattaaaaaaaaaaccttttaaacattttattgtatttctttttgaagttatctttcctaccctgattgtccacttttatagttacatatgttactttaagttactttcaattttaagtaattctgtttcactgaaaatattagaaaaaaatcagcacaatggtatctatactagtaaaaaatcttaaaagtggtgaatgcatgactgagttctgagaaatgttaacctgagttatgtcctgtggtgtgcactgtgctagctatgatgagggatgacactgagaacatgaatcagaattccctgctccctcaatacctcatatgcaatggaaaactttacttgacatctaatacacaatagccaaattatggtacctattgtactaatcccagattggaagatagttttctgttgctatgagtagcacagtaaaatatcaattcaataaatactcgataatgcttattgtatttcagtctagatttcctgaggtctagtgggtaaaggccaatgcatacacagaacataaaaatgggactgtaagtgatgaattaaaagcctttgcctggcacatcaaaaagacaactaccaggaagaagaaaattcaaatagattaaaaaggagttaccacaggagtatgaggaaaaccaggaaagtcatctccttgtgagtgtgaaaatgttcacttatgttgacagtttcaccagtcattggattcacatatttaattctgtcagaatgatgtctatgaatttaaactctgacataaaataatacaattagcaggcttgtattaactcaacaagtttttttcttccaataagtatttattaaagactcattgtgtatcacagtttgtatttgagaaagttttagtaaatcatcaatggccaccctaaggccagatcagtgaatacgataataatgagttgaccaagattcatcaagaggcaaatacgttaggtgtggaaggtctggagggttctaaacccagggtgtggatgaaaagcccaaatcccccttgaaatgaagtttgaatgcggtggtagaacactagctatcctttactgaggggtgggtcacacaataaacatttacagaacatgactgggctttttggacatggagaagaaccaagccaaggctacaaagtgcttttagtctagtgggcagacagttatacagaaatgtaattgccaaacattttgatgaaaatactgacagggctgagaagatgagtcactggaaacacagaggaaggcctctaaaaaccaggctgagggtgtgtgggtgtgatcaagctgtacaaaagtttaacttggtcagggacacagagctaaatagcagtgtggtcagttttcatcactggatcagcctgattccaatgctctgtgcagtttattccaagttcacgcctacaacaaggccatctgttttcatttggaacttaaaggtgcacttcccctggctctgctttcactttccatcatgcttccttctcctttcagactcaccataaagtgaaatagttgatcccagcctgttggcttcagagcagcaattttgagctctttcctagcactttacagcgatgctcttttctgctgagtgctgagattttttaggcatgaactctattggaaacatcacacgtgtctcatcaggaagggcaggtatatttcagcaagtacagtatacatgaactgttgtcatagtgagtggacagaggtctggctttggagacagacaaatatggatgcaaacccctgctccattacctactacccaagttactgaacagggtagttactgaaactaccctgtttgctcatctgtagaaagcagagaaggtaggaattgataaaaatctctcagggtaggctgggaaagaaaaatatgcactccttgagattatctgtttatgtttctgactgttaagagtgtgaactcccagaggacagggatgccatctgagtcatctctgtgccttaaaaactccataaccacatccaaccagagcagtctcagcacatttttcttgtgcagagctgaatcaggcctcagctgcttctgctccaaagcgatggtgcttattttgaagatcctttcttgcatcctagaggtctatgaatactactcatatgccaacgttgatgagaatctccacagaggaagatatattttgctccattgtgacttttgccgtgtctgtttccatttgcatttttgagccacacttggatacagctgaaccagaaataatttctcgttctctctgccatattaaattttatacacagacaattcaagaggcaggtctcaggccttttaaaggtataaggctttattggcagaaagactggaatgtgaacaacaaaagctttccttactatatctgccagtagcaagccataatatgtcgattttagccctaatcccattgtgctgtaaacagtggtaacgtgtatgtcttattaactgaactgtgagcttccagaggccacgaaatgtatttattcttgtttattcctctttttattcccagcacccatgacagtgccaggcacatagaggacattcaataaatggttcttaagtaaatgaatgagagcatttgtgagttttatataagaaccatacagaggaggtggcaggctaagagtggttctaaagcaatgctgatgttacacaacttgcaagtgagagagacagaagcctctagatctgcttgaatccagaagcctgcagtcttagttgtattggctttactagactctgggactccctgaagcttaccttggccactttccatggtactcagaattcagaaaggagccctgtttaggatggactttgtgtccaaggctggttcatagattagattactcatgcaataagtagttattattcacttaatatgattagctatccctccaggtgctgggaatttagcagtgaagaaaactgagactgttccttgagtaaatgtccctgctctatgaaagctggtattctagttcaaagagaaagaaaacaaacaaacaaatgcgcaacaaggctcactaaacagtatttgaggattaattattgtgagataggagtttagcaaattgcagatgaatttaatacatgaaagcaaacaacataatatcctcttatttatcttatggaagtaattaatagcaagtgatatttttgaattaaatatacgattatataagtaaaacagtataaagattcttgaattttgggaacaaatatctgattaaatagctattgcttcaagtctctttcaccaactcacacagcttctgggagcagaaaaacactttgatggagagaacgtctgagtaatacattctttctctagctgtgatatcattacagattcagccttgtcaaattatgttgaattttaaatacaaactgagtcctcatgaactagtcaccaggtattttatgcatacttattatggggttaacattaaattgggtaccagaggtacaagggaatgctaaatcattctctgccttcaatgatcatatagccttgttgggaagacaatgcgatttgaccttttacactggtagaactcaagacagtttgagctacagtgcagggaatggaatctagattcataaatacccttgatcatcacttactggttttgtgactctggacatgatcttgcactcctctgagcttatttgcctttgtgtaagttagagataataaaatccacctttcagggttaccaggaagatgagaaatgactcctgtacacagtagaatcagagtattattagtctggtacattatgtgaacatcaaagattagcacagagctattggtatagattaggcattattactcatctatagttttatggtcagaaaatgggagtggaaaataattaaatacaacctgatccatacaaacaggacaaacagaaatccttagagtagattaaatattgatctaacaatgtgatggtctagctagcaccaggaaacatgcagtctagcaacacagtagattggtaaggtgctagccactagagtcagaaataatcagttttaggatgacaggtgataggtgctcatagcagtaggggaattcaagatatcctgagatgagagatgactatgtttcaacatccattttaatgcatacagcaacaatataaggtagatactgttttataccccatttacgtataaagaaacctgagactcagaggctaatgaacttgcctagaaatacctagccagtaaaggaacaggttatgattcagacctaggcactctgattccagtacttaagacatacctggggctacttttctaaacgtttcacatgtactatctaatgtaatccttacagttgcagaatttttattaaaaagcacagttctcactcagaaagaaagaaggatttgcataaaaaagaatttcaagcccagaaatactaagattacaggtgtcaggaatagtaacatccagcctacttccagcctttctctctctctctctctctccttccctcctttcttttctccctacttccttctctctctctccctctcccaccctccctccttctttctctttcctctccattcctccctcattcaaatccaagcaatagaatattaccaagggctcctttaacattcttttgccatgaagtcaaagaactgctcctgcagagaaaagggttaattgagaccacagagaagaacagttcaccaagcatactagagtttctgccctggtaaaacatacccaaagatgatggtgactgattggagccagggattcctggaaactaagaactttacatttagggcaagggacttgagatttaaaggaaaggtaatgttagggaaactgggttgtaattttagtcctgggagtcagttggagggggagcgtagaaggtagggtcatctttgtgatggactggttcggttttgtctcagggttacatgaatctgtggagagaagccagcagtctgctgtaggcagctcataccaactcactagagctgatgattaaaaattaaattatatgaacttacaataaaataaattatattaacaacaaagaggccaggcgcggtggctcacagctgtaatcccagcactttgggaggctcaggagggcggatcacgaggtcaggagatcgagaccatcccggctaacacagtgaaaccccgtctctactaaaaatacaaaaaaattagctggccgtggtggcaggcgcctgtagtcccagctactcaggaggctgagacaggagaatggcatgaacccaggaggcggagcttgcagtgagccgagatcctgccactgcactccagcctaggcgacagagcgagactccgtctcaaaaaaaaagaaaaaaacaaacaaagataaaatactcaaaatgaatggggctcctatttctcttattacgttttactattctctgtgttcttgaagggatttgtgtttttcatctgtaccgtggaagtgttgtggaatagtatgccgctgctcatctggtctcaggtgtgtattcagtgacttcacattggtagcttgaagtaaaccatggtgggggaatttacagcacccagaaatcaggccttcatttgttgttatgttgatagactagaattaatgaaatgatgtagaaaatgttaataatgctgattaaactttaatgcgttttgtgtctgtagccactacattgtgaatagaatagcatagaaaattgaggagctattatttttgtatttaaagactattgttcagtttgccaaagaagtcactagagtcattgatgaataagtgaagttcttgatgaataaatgaagttctgatatggttctttgttatatgactcttacttgttaacataaacaagttaaaaccccaaatttatgctagaactacacttggagagatgcttgctaggtatttaccagtatatatctggccaataccttcaactcctgccgcatcccatgcacaccaaatgacctggtctcccagcactgactagtggttccagagcagtgggcattgcaagtgacatcagaagggatggttagagaaaatgggatataaggccttgaagggaacaggaaagggcaaactgaggaggggatgaaggggtggaggagctagcccatttctacgagtacatatgtgtgagaatatatagctaatgtttacttagaatgtgtttctttacaaacttcaatgcatattccatgcatattcaaggatatatatttgtacatgcatgtacgtaaataggcattcaagcacataactacaatagagttaatcaattttatttattcatttttaaacaggttaatgcatggacatattaatgtgtatgtgcaatgaatgcttcaaaattttcaaaaacactggctaattgtttcccccacttctttttactcaaaccgtaaatacattttttcagaatttcccaccattggcaggaaatagctatattttaagttatgtgctttctaaataagtataattctggaagttgtaaaaccccaatagaagctctacttcagtaactggtgcacagtgagtattcttagcttatgcatacacagatatttattggataatgatatgtcaaatgatgtacggggcacttgggattcacaaagaattgggcagtgtccttgccttcaaatatctcacagaaaacagaaattaaacaaatgtaatttatgatctggtactgggaccaggatagaagtctgatcttcatgtatgtcacactctctccagcttctaagacctcatatatattattccactctctggaaaattctagttctgcttttcacctaactcctatttatttgctatatctcagatagcgtgtctcttcttttgaaaggctatatcttgcctccatcttgatatatactgtcagaacatcttgaattcccctactgctatgagcacctatcactgtttgttgtagtttcttgttttgttgtcttcctcaacagaccatgagctccacaaggactgagatcaaggatgccttactcatttctatatccaggagcctacttcagtacctgccataccagtgtgaggaaagacactatgacagctggagggctcagttcataggatggggataaaaaacagttagaaaaaaatgaatccatgccaatttcctattcatatatcacagtcaaagttgcatgatcggacatgactagatgctggaaattcactgatgtaggttgtattcttaatattcaaatagtcgaggattttatttagcaaggaaataaaatttgggagcaatgattttatgaaagatgtcctatttcacggaaaggacacagaaaaaaacagtgcctctttctcttcttgattctattcttcctggttgtaattcctagaatgcttattatagaggaaagcatcctaactactgggcttctttcccagagattctgaggaagcaagcgtcatcccattccctatgaatttctcaagtgttaaagtaaaatcatccaacaatgtgccatcacttataacgtccactggagggcgatatactactgctggtaccaccttctatagcatagcccgcgaggactaactttagtttcctaacaatgtaattataagtcctcatagtgcagaacacctaataaataaaagaagccttttcagtagatgtgaagatacagatgagaagatggaaatggcaccagccctgcgcccacctcccatttccttacctatgaccccagggtagaccaggttcccaggggtcctgtaatacttcccctccatgctgacttgtgactaacacagaacacagagctaatggtttcacctagaacatggccggtctctttaggttcctgggtatctcatcctggagagaggacaagattaggagatgagtgttattatcataacaattttagagatgaggacactaaaactgaggtccaaataagtttattaactggcccaagaataaacttattaactggcctcttttctgtgctcccacagcaccccactttttcctagtcacactgtatttggaggctttctcattcgctaaatggaagtgataaggacctagagactgtgttttttgttcactgttctatcttagcatggaaaacagtgctgggcagccaggaggcataaagtggaggaaggctaggcagagaatagggtatgaggtgggagaggatgaggttccatctatggtgattcccctgtcacagcttggatgaatgtggatggggaagaaacagtggatgttgtctgataaatccattaagaggagaaagatcatgcagcaccctacggatttacttcctattactccttctaccctgtcactggattgatgtaactctcactttaagtgtccaaaaacatcgcacctgagagggtatccatgaaagtatctaaatcttaggatagagtgcaatcatgacccttggttctatttatcagtgtcgtcacctaataagagcaaccatcatagcaaattcttgagtgcctgctgggcgttagccactgtaccagcagattatacacacgccctcatttcatcctcacaatgaagatgagggtgggcttttatagatttttttcttttttgagacagagtcctgctctctcacccaggctggagtgcaatggcgcaatctcggctcactgcaacctccgcctcccgggttcaagcaattctcctgcctcagcctcctgagtagctgggattacaggcgtccgccaccacacctggctaattttttgtattttgacagattttacaaagctggacagtagtgcatagaagagttgggttttcagcccttgctctttccttgaagtaagagatgcctgaagcatggcacagtggccactgtcagggtccatgatcactaatggctcacaaacattcattcacaattttgaagtgtaagatatacttctgtgcaatagaaaaaaagacagctaacacataaagtaacattaactttaaagcctcctttggaaataaaggggaaaacactgacttcctggaacctgtggtaaaatcccccaaagactcccttaaacacctcttgctttcccctatattccttgctggatataagctgctcgttgcttctctttctctccagttcttactcagtcatccccttccccaacagcttgttctttctcaggttttagcccccctcccattccttctcaccagcacaacagtcctctgcttgcattctcacacacagaaaccagcctagcatgcttaaactgtatgccaagttaaaagggtgcttggcactcttgaacatgagtctttaaccaaactgatgaatgatttgcacatggcttagagaagcaaaaattatcagaacacgctttaaaagtcattctcagaaaaagagagaaattatatatacacatttctttggacagaaacactgacatggcagaagcatgacatcttgagtcatttttttccatccctctggatctattctatgcaatggagtgtaatataggtgtaactcagtgcaatttggtattttctgaccaccaatatgactgaaccacctaaggcatatatgcatgttcatgttctcccttcctctctccctccctacctcaactcaatccctaggtggagaaggactggggcaagctattccaaagaacaaaggaggaatcttggggagtagagcaacatgttggagaaaccaggtcacaaaaaccttccctttaggtaggggtaggggaagatggaaaagaagaggtatgaattgaaaggtggtagcatctcttatgtgaggcatagccatgtcatctctcatatacatggaaacacaaacttacttaattgatctcttttcccttcgttgaaaaggtaagtcaagttaaacaattcaacatccaatgaaacatgtacagaggagagacagacagcaagtaaaagacatatggaaagagtatccaggcccttttaccgaagtagtagaacaatgcagacatttattagaagtttgctcctttgaaatattattattacactgaaagttggaaaaaagctaaacatccatcagaggaggttgattacataaattatgaaagatccatattttttaattctatgaagccataaaatgataatactgatatgtatcattgaacccaccactgattgtttgataaaaatttcagataccaagaattacatataaattagagttggttttgtaatatacagcatagaaatacatacttttctattattaaatatttactgatttctgaatacttacacatgtataagataggtatttagaaagattaaagagggcatacagcacacagacgtttctcattcctatctcccatctcctttcccagagacagtttctaaaacaaaactgaggaaaatactaacatcattcgtctaataagagcaatgaggtatgtaatactaatgaatcttaaaacatatcatataaaaaacactagataactggactaagtagtgcaaacgtgaatgtctatctaaaacacacacgtcgcacacacacgataatgaatggaagacgtcctagcacatgtttacaaactgtttgtgtgttgccgtcctacacaccagacgcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttatcgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctcttttacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccacagtttcctgaacgtctcccagcgctcccgctgtgcgcccaggtccagctccttaggggactcggcgggcgccggcgggtccgggagtggcgcggagggcagcggatctctggagcccgcctcccgggcccgccgccaccggcgcttccgccgcaactttcccagccacctcttggccgccgcgtggctcccgaccccgacttggacccgggggcactgcgcgcggctggcgcccatgaccgcgatggccgcgcaggcggcgggaggatccccgggccgctttcgcctccgccgctgagcagtggcgcggttcctcactctgcccatggcgcctgcagcctccggagcgcgtgcccagcccgctacccccattttcccgtcagttgctgagcagcctccttgtctgcgccagcaggattggccacttgttgaatgtgatgtaaagggacccttcccttgaccctatcacaacagcctttgctggcccgaaattctgactgagcctatcagttgccccttctcctaaatgttaatttctattgttgattcaaatcatcagcctaaccttaacatattgaaccactgaaaatactgtagatcttttagttagcatgcaacagcaggtagatcagcttaagaaaaaagaattattcatctactatagaagagacagagtcatgcataaagccttggggggagaaaatgtgtggtgtgtaagtagttgtaccaaagttaagtgtagtaaagatgatgatccacagtactatgttacatcggtggacccaaccagagaaaatacaggcaaaaaaaaatttactcatttaaatccatcttctaaggacaagagataaaagaagaaacagtacatttatttttgtgtctgtgccaagaacaaattaacagctctggcaggcatgaatatgaagtggatattttgttcttttaagattgatttggttgatcgttgggcatagtcagaggagagaccccacaaaatgagcacagatcttcttttctggggtgcaataagtacctgggaaaacagtgagcagtcttaggaaagctgcttcttgtgagttaagtagtaacatccacacacatgggttttaagcagagatgcatccatctacccacaacctagattcaatgattcttaacattttgttgtatgtacctatatgcgacaactgtagacagaacagtaattcgataggaattacatgtatctatatgcatgcatatgtgcatacattttttcaaaaacatttaaagtaagatacatacattaatgccatgttgtctcaatatttcagcactcacatcctaagaataaacatataatttctctttttttgaagctcaagattatgtatttacttatttttgtaagttcggtgctacatgtgcaggtttgttacttggatatgttgtgtagtggtaaggtttggggttctagtgtacccatctcccaaacggtaaacaccgtagtcagttggtactttttcaactctcatttccctcccaccctccctgcttttgcagtccccgtgtctattatttccctctgtgtgtgcatgtgtacccattgtttagcttccacttatgaatgagaatttgattttctgtttttgggttattttatttaggataatagcctcaagctccatctatgttgctgcaaaatacatgatgttattcttttttatggcagtgtagtattccatggtgtatatatagcatatttttctttattcaatcatctgttaatggacacaaagtccatgacttcgctattgtgaatagcactgcaataaacataccagtgcaggtgtctttttgatgtaacgatttattttcctttgagtagatacccagtagtgggattgctaggtcaaatggtagttctatttttaactctttaaggatctccatactgctttccacaggagtcgtactaattcccaccaacacgatataaacgttttcttttctctgcatccttgccaacatctgttagtttttggctttttaataatagccattctgactgctgtgagatggtatctctctccttgtgattttaatttacatttctctgataattagcaatgctgagcattttttcaagtgtttgttggacattcgtatgtcttcttttgagaaatgtctgttcatgtcctttgcccactttttaatggggttatgttttttttcttgttgatttgtttcgttccttatagattctggatattagtcctttgtcagatgcattgtttgtgaatattttctcccattctgtaggttgtctgtttactctgttgattgcttcttttgctgtgcagaagctgtgcagtttaattaagtccaatttgtctatttttctttttcctgcattgtttttcaggtctcagtcataaattctttccctaggccaatctcctgaaaagtttttcctaggcttccttctatgatttttatagtttcaggtattacgtttaggtctttaatccatcttgacttaatttttgtgtatggtgagagataggggtccatattcttctgcgtatggtgctaattttcccagcaccatttattgaatagggtgtcctttccccgttgtttatttttgtcaactttgttggagatcagttggttatggctgtgtagcttcacttctgagttatctgttctgttccattgatgtgtctatttttgtatcagtatcatgctgttttagttactatagccttgtagttatagtttgaagttaagtaatgtgatgcctttggcttttgtctttttgcttgtgattgctttgactatttactctttttttggttccatatgaattttagaatttatttctaattctgtgaaaaatgatattggtaatttgatagaaattacattgaatctgtacattaatttgggcagtatggtcattttcatattattaattcttcttcttcttcttcttcttcttcttcttcttgttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttctttcttcttcttcttttttgagacagaattttgctcttgttgcccaggctggagtgcaatggcgcaatcttggctcactgcaacctccgcctcccaggttcaaatgattcttctgcctcagcctcctgaatagctgggattacaggcatgtgccaccacgcccagctaattttgtatttcttgtagagatggggtttctccatgttggttaggctggtctcaaactcccaaccttaggtgatctgcctgcctcggcctcccaaaatgctgggattacaggcgtgaaccaccgcaccttgctgatattaattcttctaatccatgagcatgggatgttttttcatttgcttgtgtcatctacaatttctttcagcagtgtcttgtagttttccttgcagagctcttttatttccttgcttaaatgtatttctaggtgttttatttgtttgtgtgtgaatattgtagatgggattgagttcttgtttttatttttagcttgaacactgttggtgtatagaagtgcaactgatttttgtatgttaattttgtgacctgaaactttactgaagtcctttatcaagtctaggagtcttttggaagaatcttcagggttttctaggtacaagatcaagatataatttgttatacagccacaatatcattttcacatctacaaatcattaatgatttcctaatatcttctaactcccagtagatgtttaaatttctccaattgtttcctaaatgtgttttataaaaagattcttccctaaacacactctaattaatatttacacatcagattcagttgatatgtctttttagtctcttcaccaacatttattttaataggccaggacagttatctgctgattttgtctgattgtttcctgtgccattagattgctcacttatctatttcctatataactaaaagtcacatctaaaggcttaattaaattcaagttacatgttttggcaactatgtctcataggtggtattgcatacttcatatttcaccacatcagaggtttgtgataccaaattattccagtagtaataaaactaaatgttatctcttcactaaagtggtaattgctatatttttctattatgaaagcatggtctttctttgcaataagcaagtaatcttgttgcaggacaagcaaaccccaaatcaagacttaaccaaaaagggttcttggcttcacccagaaaggatttcaagggttagccggtagtattagctagcaatcttctattgaacacactgctccccttagagcatagctaactcataggcagtgcacccagagtcagcaaagtatgatgctcttggcaactgtatttatacttacatggaccctctttcaattacctgcaaattaaggggcaggtcaatgcaaattgaggggtgaggtatttaaaactttctagggggagaggcggttccaagatggctgaataggaacagctccagtgtacagctcccagtgtgagtgatgcagaagacagggtatttctgcatttccaactgaggtaccgggttcgtctcactggggcttgtcagacagtgggtgcaggacagtgggtgcagtccacctagtgtgagccaaagcagggccaggcatcacctcacctgggaaatgcaaggggtcagggaattcccttttctagccaagggaagctgtgacaaatggcacctggaaaatcgggtcactcccaccctaatactgcacttttccaatggtcttagcaaatggcacaccaggagattatatcctgcgcttggctcggagggtcccatacccacggagcctggctcattgctagcacagcagtctgagatcgaactgcaaggctgcagcaaggctggaggaggggtgcccaccattgctgaggcttgagtaggtaaacaaagtggccaggaagctcgaactgggtggagcccactgaagctcaaggaggcctgcctgcctctgtagactccacctctgggagcagggcatagctgaacaaaaggcagaagaaacttctgcagacttaaatgtccctgtctgacagctttgaagagagtagtggttctcccagcagggagtttgagatctgagaatggacagactgccttctcaagtgggtccctgacccccgagtagcctacctgggaggtaccacccagtaggggcaggctgacacctcacacagccaggaacccctctgagatgaagcttccagaggaacaatcaggcagcaacatttgctgttcagcaatattcactgttctgcagcctccactgctgacacccaggcaaacagggtctggagtggacctccagcaaactccagcagacctgcagctgagggtcctgactgttagaaagaaaactaacaaacagaaaggacatccacaccaaaaccccatctgtatgtcaccatcatcaaagaccaaaggtagataaacccacaaagatggggaaaaaacagagcagaaaagctgaaaattctaaaaatccgagtgcctctccccctcgaaaggaatgcagctcctcaccagcaatggaacaaagctggacagagaatgactttgacgaattgagacaagaaggcttcagacgatcaaacctctctgagctaaaggaggaagttagaacccattgcaaagaagctaaaaaccttgaaaaaagattagtcgaatggctaactagaataaccagtgtagagaagtccttaaatgacctgatggagttgaaaaccatgacacgagaactatgtgacaaatgcacaagcttcagtggcctatttgatcaactggaagaaagggtatcagtgattgaagatcaaatgaatgacatgaagtgagaaaagaagtttagagaaaaaagagtaaaaaaaaaaaaaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaacctagcaaggcagaccaacattcaaattcaggaaatacagagaacaccacaaagatactcctcgagaagagcaactccaagacacataattgccagattcaccaaagtagaaatgaggaaaaaatgttaagggcagccagagagaaaggtcgggataccctcaaagggaagcccatcagactaacagcagatctctcagcagaaactccacaagccagaagagagtgggggcaaatagtcaacattcttaaagaaaataattttcaacccagaatttcatatccagccaaagtaagcttcataagtgaaggagaaataaaatactttacagacaagcaaatgctgagagattttatcaccaccaggccttccctacaagagctcctgaaggaagcactaaacatggaaaggaacaactggtaccagccactgcaaaaacatgccaaattgtaaagaccatcaaggctaggaagaaactgcaccaactaacgagcaaaataaccagctaaaatcaaaatgacaggatcaaattcacacataacaatataaaccttaaatgtaaatggactaaatgctccaattaaaagacacagactggcaaattggataaagagtcaggacccatcagggtacagtattcaggagaccaatctcacatgcagagacacacataggctcaaaataaagggatggaggaagatctaccaagcaaatggaaaacaaaaaaaggcaggggttgcaatcctagtctctgataaaacagactttcaaccaacaaagatcaaaagagacaaagaaggccatcaattcaacaagaggagctaactatcctaaatatatatgcacccaatacaggagcacccagattcataaagcaagtccttagagacctacaaagagacttagacgcccacacaataataatgggagactttaacaccccactgtcaaaattagacagatcaatgagacagaaagttaacaaggatatccagaaattgaactcggctctgcaccaagcggacctaatagacatctacagaactctccaccccaaatcaacagaatatacattcttcccagcaccacattgcacttattccaaaactgaccacatagttggaagtaaagcactcctcagcaaatgtaaaagaacagaaattataacaaactgtctctcagtctacagtgcaatgaaactagaactcagaagtaagaaactcactcaaaaccgctcaactacatggaaactgaagaacctgctcctgaatgactactaggtacataacgaaatgaaggcagaaataaagatgttccttgaaaccaatgagaacaaagacacaacataccagaatctctgggacacatttaaagcagtgtgtagagggaaatttatagcactaaatgcccacaagagaaagcaggaaagatctaaaattgacaccctagcatcacaattaaaagaactagagaagcaagagcaaacacattcaaatgctagcagaaggcaagaaataactaagatcagagcagaactgaaggagatacagacacaaaaaaactttcaaaaaatcaatgaatccagcagctggttttttgaaaggatcaacaaaactgatagaccgttagcaagactgataaagaagaaaagagagaagaaccaaatagatgcaataaaaaatgataaaggggatatcaccaccgatccaacagaaatacaaactaccatcagagaatactataaacacctctatgcaaataaactagacaatctagaagaaatggataaattccatgacacatacatcctcccaagactaaaccaggaagaagttgaatctctgaatagaccaataacaggagctgaaattgaggcaataattaatagcttaccaaccaaaaaaagtccaggaccagattgattcacagccaaattctaccagaggtacaaagaggagctcttaccattccttctgaaactattccagtcaatagaaaaagagggaatcctccctaactcattttatgaggccagcatcatcctgataccaaagcctggcagagaaacaaccaaaaaagagaattttagaccaatatccttgattaacatcgatgcaaaaatcctcaataaaatactggcaaaccgaatccagcagcacatcaaaaagctaatccaccatgatcaaatgggcttcatccctgggatgcaagtctggttcaacatacgcaaatcaataaatgtaatccaacatatatacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcataccgaatgggcaaaaactggaagcattccctttgaaaaccggcacaagacaaagatgccctctctcaccactcctattcaacatagtgttggaagttctggccagggcaatctggcaggagaaagaaataaagggtattcaattaggaaaagaggaagtcaaattgtccctgtttgcagatggcaagattgtatatttacaaaaccccatcatctcagcccaaaatctctttaagctgataagcaactttagcaaagtctcaggatacaaaatcaatgtacaaaaatcacgagcattcttatacaacataacagtcaaacagagagccaaatcatgagtgaactcccattcacaattgcttcaaagagaataaaatacctaggaatcccacttacaatggatctgaaggacctcttcaaggagaactacaaaccacagctcaacgaaataaaagcggacacaaacaaatggaagaccattccatgctcatgggtaggaagaatcagtattgtgaaaatggctgtacttcccaaggtaatttatagattcaatgccatccccatcaagctaccaatgactttcttcacagaattggaaaaaactactttcaagttcatatggaaccaaaaaagagcacgcattgccaagtcgatcctaagctaaaagaacaaaactggaggcatcacgctacctgacttcaaactatactacaaggctacagtaaccaaaacagcatggtactggtaccaaaacagagatatagatcaatggaacagaacagagccctcagaaataataccacacatctacaaccatctgatctttgacaaacctgacaaaaacaagcaatggggaaatgattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacttaggcaataccattcaggacataggcatgggcaaggacttcatgtctaaaacaccaagagcaatggcaacaaaagcccaaattgacaaatgggatctaattaaactaaagagcttctgcacagcaaaagaaaccatcatcagagtgaacaggcaccctacagaatgggagaaaatttttgcaatctactcatctgacaaagggctaatatccagaatctacaatgaactccatcgaatttacaagaaaaaaacaaacaaccccatcaaaaagtgggcaaaggatatgaacagacacttctcaaaagaagatgtttatgcagccaaaagacacatgaaaaaatgctcatcatcactggccatcagagaaatgcaaatcaaaaccacaatgaggtaccatctcacaccagttagaatggtgatcattagaaattcaggaaacaacaagtgctggagaggatgtggagaaataggaaaaattttacatggttggtgggactggaaactagttcaaccattgtggaagacagtgtggtgattcctcaaggatctagaactagaaataccatttgacccagccatgccattactgggtatatacccaaaggactataaatcatgctgctataaagacacatgcacacgtatatttattgcagcactattcacaatagcaaagacctggaaccaacccaaatatccatcaatgatggactggattaagaaaatgtggcatatatacaccatggaatactatgcagccataaaaaatgatgagttcatgtcctttgtagggacatggatgaagttggaaaccatcattctcagcaaactatcgcaaggacaaaaaaccaatcaccgcatgttctcataggtgggaactgaacaatgagagcacttggacacaggaaagggaacatcacacaccgggacctctcgtagggtggggggaggggggagggatagcattaggagatatacctaatgtaaatgacgagttaatgggtgcagcacaccaacatggcacatgcatacatatgtaacaaacctgcatgttgtgcacatgtaccctagaacttaaagtataactaaaaaaaacctcactattattaataaaacactctagaatacttattttaaaaaaaactttctagggaagaggtgataacttcttgattgttgtcatggcaagcgtaaactgtgatggcactggtgggagggtcttatgctaatgagtagtgacggcggctagggattgcgctcatcaccatctactggttcctgctagtttctttgcttcatcccgtctggagcagatcctgttttggtccgcagggttgtgaccagaaaacaagtcctgttggtctcccacctcaatctgacggatattattttgacacagtgtaagtatcttgttcctttacagcttttttccttgtggttttagaatctgtcagtaatctttgactgaaccaattatttcactgttgttacgttacaaaatgatacttttctaattctaaattcccttctatttttattagctggtattcacccataaagacgagctttttctcatcaactgtggatggactattttttctcccttaaaggcaggatacatgctttattcttttactttaattatcattttgcggaataaagagttggagtaatagaaatctccaattatgaaacattattctccctttttctatctttctctctctttctctgggtataactttggattcacggatttttattcatttaataatttacaatcatcaagtaagtaatcgaattatcccaattttggcccatgggatttctttcaaactggttcctgtatccttttgcatttctccattaatctttgagcacttccttgtttcctggaacaactagatgccccagtatctctttgtaatttttacttttgccatctgatccctggaatcacatatttctccaaagacctccggttccttttagcagagtatgatatttagaaccatacctgggcacatcatgacacattatttattatcaaaatttttattgaatagttgtagacatgcatactgttgtaatatataatacagagagatctcttgtaccctttatccagtttcctccaatagaaccattttgccaaactatagtaagacaacttgtatatttgtatatttttattgataaaatcgaccaattttgttcgaatttccccagttttaaatgtattcatctgtatgtgtgtatttgttctgtgaaacatatatatgtgatatatatgtgatatagaacaaatacacacatacagatatagagataagtgtattgcatgtatgtgtgcatatatatatatatattttatatatatataatatatatatattatatatatattttatatatatataatatatatatattatatatatataatatatatatatattttatatatatataatatatatatattatatatatatatatatatatatatatatatatgtaggttttataggttcatgtcccatcattacaatcagtaacaccggtaccacaaatctgtccaacatttccaatattttgtcatttccaaaattttatataaatgaaatcaaacagtaagtaactgttttgaattggcttttttctctcagaattatactctgagtatcatccaagttgttgagtgtattgatagttcattcttttttattgttgagtggtgtgtgtgtactataatttgcttaaacatttacctgtttaaggatatctcccagatttttagctatgacaaataaatattccacagacatttgtgtacaggtttctgtgtgaacataagtcttcattttgctaagatgaagaacgcgattgctagagcatataataattgcatatcttgttttataagaaactgccaaactatttttcagagtgactgtacaattatacattctcaccagcaatgcacgagtgatccaatgtctccatatcctccccagcattttgtgttgtcactgatttttattttagcaattctgatacgtatgtagtgatatctcattatgattttaatttgcatctctctcattgctaatggtgttgggcatcttttcaagtatttatatgccatctgtgcagccgtatgtctttgcccattttctaattgggtttttgttggcttttatttgtttatttcacatttttactgttgagtttaagagttatttgtattctgaatagtatttctttgttagatatatggcttgtaaatattttcttttagtctgtatttattttttcatcctcttcacaatggtctgagaactttttggttctgaatcacacagattttctcatgttttttttttctcaaagttttaatgtgattcactttcagttaattatcattattattacttttttgagacagggtctggctctgtcacccagactggagggcagtcgcccaatctctgctcactgcaacctcggccttctggggctcaaatgattctcccacctcagccacccgagtagctgggattacagatgcgccctaccatgccctgctaatttttgtattttttatagagatggggtttcaccgtatcgcctaggctggtctcaaactcctgagctcaagtgatccacccgcctcagcctctcaaattgctgggattacaggcatgagccactgcacccagcccactttcaactaatttttatataaggtgttaggtttagatcaagcctttattttcttactttctggtttttttccccataggaatgtccaatttccttagcaccattttattgaaaaagctatcctttctccactgaattgctcttccaccattgtcaaaaatcagttgagcatatttgtgtctgtctatttctggattctctattgtgtttcattgatctgtgcagccatacctgccccaataccacactgtcttgactacagccttattatcagataggtaattcctcaaatttttgttgtttttcaagattatttaagctattctaggacctgtgtctttccatacaaattttagaataagcttgtctatgtctgcaagaactttgctgggatttagataggaactacattaaacctatagatcagtttgtggagaattgacgcctttactgtactgagccttccaatcaactaacacagtgtacttcaccatttatttacttcttctttgattgttttcatcactatattgtaatagtgttcagcacacaaatactgttcatgttttgttaaattcatacctatgtttcttagtctacttgggctgccataacaaaatcccatagcctgggtggcttaaacaatataaatttgttttctcacagttctagagactggaaatcagagatcatggtgtcagcatggtcaggttctggtgagggctctctttctgtgctcagatgacctttctcagagaaaagcagggaaagagagtgagagaaagagaaagagagagagattccttcctattcctataaatccactaatcctatcaaattagaaacccatcattatgactcagttaaccttaattatcccctaaagtcctcatctctaaatatatttacattgggggttaaggcctcaacagataaatttggtggggagaggacacaattcagtccatagcactaagtagcttgttttctttgcagtaattgtgaatggtactgtttttaatttgctttcctcatgttcactattactataaagaaataggattaattttaatgtgtcgatcttttatcctgtgacatggctaaactcacttacactaagtactagaatttttctcttgtattaatactaagactttttggtagactccttggaaatttatacatagacaatcatgtcatctgcaaatagagataatttaatttttcccccaatttgtataactttttaaaaatcttgctttattgcaccaactggacctggtattatgttgagtaaaagtggtgagatcataaatccttgccctgttcccaatcttaggggaaaacatttagtctttatcattaagtatattagcagttttcttgtagatattctttataaagttttggaatttggggcttttgacaaactctctgtaactattgataggattttcctttttccgctctttgatgtgttgaattacactgactgacttttgaatgttgatccaggagcctcgaaaccctggaataaatcccactttatcataggcataatttttttatatttttgggttcatttggttagtgtttgttgaggacctttgcatctcaattcatgagagatattactctacagttttctcttcgcattgactttgtatggttttagtatcagggtaatactggcttcataaaatgtgttgggagcttttcttccttttctgttttctccaggaaattgtgtaaaattggtattagttcttcctttaaagattcataatgttccagtgaatatttattataagaaattgaagcaatctggctttggagattttttttttatcaggagcttttatagtaaaagttacttcttttttattgttagggcccttcagatgatcaattgcatactggtgagtgttggtaatttgtgtttttcaaggaatttgtcataaattatttaattatcataatatccattaattatactctttgtatagttttcaaagtggttactctagtcatttttttttattatttatttatttatttatttatttatttatttatttattgagacggagtttcactcttgttgcccagactggagtgcaacgacgcgatctcagctcaacgcaacccccgcctcccgggttcaagcgattctgctgtctcagccttcccagtagctgggattacaggcatgcgccaccacgcctggctaattttgtatttttagtagagacggggtttctccatgttggtcaggctggtctcgaactcccgacctcaggtgatctgccctcctcggcctcccaaagtgctgggattacaggcatgagccactgtgcctggcctactctgattattttaatattttcatgatctgtagtgatattcctatttaattactgatactgttgatttgtgtatttttttcttctttcgttcagtctgctaaaggtttatcaatgttggtgatttttttttttgaagaaccaactttttgtttcattgattttctctattattgtcatgttttcaatttcattaatttgtgttcttgtcttcttttttaattattattttttttttttgagacagaatctccctctgtcacccaggttggagtgcagtgggtgtaatctcggctcactgcaacctctgcctcccaggttcaagtgattctcccgcctcagtttcccaagtagctgggattacaggcgctcaccaccatgcccagctaatttttgtatttttggtagagacggcgtttcaccatgtttgcaaggctggtcttgaattcctgacctcaggtgatctacccgccttggcttcccaaagtgctgggattacaggtgtgagtcatcacccctggccggtgttcttgtctttattattcctttccttctgtccatattttaaattttagttttctcttgtttttctactttcttgatgtgagaccttaggttatttttaaaaacattttctcattcactgctgtaaattttctcagcatttctttagttgcatcctacatatattgatatgttgtcttttattctcatcagttgtatgtattttaattttaattttgagacttctctttgacccatttattacttagtagtgtgttaatttctacatatgtagagatatacctgttttaaaaaattgatttgatgattgattcctttatggttgccttttcactctgttgattgtttcctgggttttttttttttttttggctatgatttctacttcttctagaagtcttaaagtttggggtcttacgtttaagtctttaattcattttgagtttatttttgtacatattgtgagataagatccaatttcattcttttgcatgtggatagctagttttcctaatactgttttttgatgagaccgtcattttcccattgtgtattcctggcaccgttgttgaagatcacttgaccatataagtctggtattattttcggggtctctattgtgtccctttggctaatttgtctgttttttatatgtctggttttgggtttcattttgttttgttttatttttgagacagggtctcactctgatgcccagactaaagtgcagtggcacagtcacagctcactacagtctccacctcccaagctcaagctatcctcccacctcagcctccagggtagctgggaccaaaggtgcatgccaccacacctggctaatttttttactttttgtaaagatggggtctccctatgttgcctaggctggtctcgaactcgtgggctcaagtgatcgccccaccttagcctcccaaagtgctgggattacaggcatgagcgtccacatctgacctatatgtctgtttttatgccagtaccatactattttgattactgtagctttatagtacactatgaaatcaattttgtttttccttctccagattgatttgggtatttatggtcttctgtggttccagacgaagtttagaattattttttctattcccgtaaacaaacatgccattaggattttgataggtttacaatgaatctgtagatcactctgggtattagggatattttaacactattaagtcttcagatccatgaacacttccatttgcttgtttcttgtttaattttcttcatcaatattttgtaattttctgtatacaagtctttcacctccttcagtaagtttttatctatgtattttattctttttggtgttcttgtaaatgagtttgttttcctagtttcctttttagataattcgttattagtgtatagaaatgcaattgatttttatatgttgatttgtatcctgcaattttattgaatacatttattctaacaatttttagaggaatctttagggttttctaaatataagatcatattacctgcaaaagggacaattttactttttactttctgatttagctcccttgaattattattattattttttgattaattgttctgaataggactgctggtactatgatgaatagaagtggtgaaaggggcatccttgtcttgtccctgatcttagaggaaaagccttcactttttcaccattaagtatgatgttagctctgagcttttcatatacagcctttatttgttgagataattttcttctggaactcccataagtcatatattggattgcttgatggtgctctatgttgggaaaaagtcttatggggtgcctgtataaactggccataaaaacatggaacaataagttgtggaaagccacaagaggcctctgaggaggaaagccttcttatcgccattatgttcccatgctctgagcgagacttggtctcttatccataaacattgtgttcaaggagaaagacactcctttgaagcattggaatgtggccagatgtgcaggctcctagttaaggccgctcccactagccactctctgataagttaaagatatgctgtttgagcacaaaggagattcatttaaaccgctattgctatagattacgcctatgacgcactgcctccctttcactgtttcgccctgaacatctgcttcttagatttaagtgatcatactcaataaatagtgtggagactagaactctgggccttttgcagcctccattttgcaactggccccctggctcccacctttatgaactcttaacctgtctcttatcattcctttgtcgccaccagactttgggtaccctactggtggtgttgaggctggtacccaatagctctatgtatctcttaagctttcttcactttttcattactcttctgtctctgcttaagttcctgctggtaccacctggaaaaaagaaggtgcttccttttgccttccaagtatcataaagtgagttatggggaatccaaagcaatggtgcagaaagtgtttcccctgattttttttccagccccccatagccagcgaactttccactttatctctgccagtgcagacaggagtgggctgccttccgccattgtgtggaggagcaggagccatgagtctgggtggaaggttaggagaccccagcccaattcaccttctgccactgggtaaagagccaggagacaacaggcctggattgtcttaagccattcggtatagggccaggacccactggatgtaggtagcggtctaccaatgggtagaagatcaggagacactggacttaggctgccctctgcagttgggtggagtgctggaagacaccgggccagctggcattagcatttcaggtagaaaggctcatctctggcctcctggtatggggcagagagtatgttaacctacctgggtccccctgttactgctgtgggtaggtctgatcctgtcattgctgctggctggtgtaggtgtgggggatggattggtcttctctcctgcagctttgctggtgcagctactcccggcagatcagccagctgctgccactggatatgaatctccctgctaagttcctgctaagctttccctttcctgaacctttgttcagagaaagcaggcttttcttttgcatttctttatttgtttatctatttttggtctaccctattggcagtttctgggttgcacacctcccagacacccagtttgggatacacgagtgatataaagaaaacctggggagctcattatggtgtcttcttcaagtcctgaggctcctttccagtctaccttcttcctatatttgagaatctgttaaattattttcaagatatttagttgtatttagagggaaggaacagggaaaagtaagcctatgccattgtcccagagccagactaaaaccactaagttttgacatactacaatctaaatatctttattttttttctctctaggttacatttctggttccagctaagaaaggtgatgaaaagttgctttttagacaaaataagcccttaccctcaaaggaaagttgctcctgaaatacaagcagaaatcagtggtaagtcatacagcaaatatctaaagcattttaggtatttgtttttagaccgttgtccaggatctgctctactcacctacaagaaagaaggtgcttctttttgccttccattttagccaattgtccaggatctgctctactcactccagaaaaattggaaaccaagcttctactagttctctaagtattatactggagctagtagatttttattcaaacacttaaagtttcaggacatagtaaggcaagaaacagagaacataataaaaatgtgttgtttatctcagttgcaatgagaatatctaacacccagataattgtttctaagtatcatttcttaatgaaaggagccaggggtccttggacaaaccattgattccagggataaagtatggaaagcataggttaatgtggaacatcttaacgggacagaaagtaaggcagcactcaaaaaattacatagacttgtcaaaaggatatagaaccagcttgaatggggctcacattgcttaaacctaggaaatttgagctttagaataaataattataacaatgagttataaaaaaattgaataaaataagaatccattaatctgtactaaaagtaaataaaggaaaagctcttcgttacagtagaatcccatccaataaatgtagaagaaatgatgctgttagaaaaacaccattttataactatcatgtaataattgtctaggacaagagtcattaatgaatactaaaattagtgtatggaagctttgtgattaatgggatagttacacgttctcaacacctctcccacaaaacaggtaataattacaaaggaaaaataatttgcattggagtaagctggcagacaccactttaaccacgtgatcaggttgccagaatcaatattgggacaatccatatcatatgctggcctttatgatgtaacgagaaagacgtgtggcgctcctgccatatatgtctaacttacatagaatcatgagaaaacaatcagctaagccccaaatgaaggacaccctacaatatcattagcccgaactagcaggcgtgatgtagcccaaactacaaggcatgatgctgaaatggacctttcattaggagaaaaatcctataaaaggcattattagaaaaattggtgaagttcatttaaactctgtaacctagatattgtcatcaatgcaaattttcttattttgataactatatttattcttaggaaccataatgaattatttaggagtaagacataaagtctgcaacttattctcaaatggttcagaaaaaaaagttacatgtgtgcttatttgtgtgtatatatgtgtgtatagagagagagggagcaagaaagggagagataacatgataaatcagatggtaaaatgttaacaactaaggaatttgagtgaaggagtaaagggtaaatgtgaatttcttgtactatccttgtaacatttcttttttctttttctttttctattttgagatggagtctcactctatcacccagcctggagtgcagtggcgcgatctcagctcaacacaacctctgcctcctgggttcaagccattctcctgcctcagcctctggagtagctgggattacaggtgtgtgacaccatgcccggctaacttttgtattttgagtagagatggggtttcaccatgttggccaggctggttttgaactcctgaccttgtgatccactcgcctcggcctcccaaagtgctgggattgcaggtgtgagccaccgcgcccggccccttgtaacatttctatgtttgaagtcacctcaacatagaaagttcagaattttttttctaatcatacatcacagactgcctggatgggagcatatgtgtatacacacacacacacacacacacagagagagagagagagagagaggagtttcaggtaattttcatgctggaacaatgaattccaacttggtgatgctatgccaagtaaacagtaatgtctgaaacttttgaacacagatttcaaaccaattagctccaaacctatgtacacataaattcaaataataacatcaccatctttgagtacttataatatacttggcactgttttaaatgcctaaaatgaattatcttagtccttacaagaccattatgaggtatcctctgacatgagatagttgatatgattttcctaattccacaatagaagaagcagaagcacttgctgaggcatctcagataatgtgttgaaggtcatgttgccagaaaggggtgtggtgggatttgaacccaggtggcctgacactgtgcctgtgatctttaacttaaactaagcacatggtgccctaatagttttgaagtggggtgagacacgtaaacccatatcctttgcgatctgctacaggggccaggtaagaaacctgttccttgaatgccccaggctgtatctggcccacaggacctcatcatgcatgctgttcctctgtctggacaactcttcacacaccttcaactcagttaactgccactcacttttcacatctgaacttactggtcagtcacttggggagactgtaccccctaaacaagattatagtttcctgccacatgccgtcagagcccactgaattctgcctgtcacacaacatattcatcacagtcgaagattatttacttgtctgcctcccccagcagactgtgaattctctgaaatcagggttcatgcttgccttgctcagccctgaagccccagatccccactgcacagaagtgtgaggcccacagatctgagaggtgaaatcagggagttagtatgggaatactggggtatataggagtaattcatcaacatcctttttctattaattcaagtcaggctaaaacggatgaaaaggatttacgttttcctggaatggaaaatgatagaggataagattaattagcctgaatgaatcaagatcgcattcactattagggaagggtaagcgagaacagactgtgagggcaagatgtttatgggaaatgttttcttattcttaaaaacaaaaacaaaaacaaaaaaactgcactaaagggaaaaccagcgactcttattctgttggaccctattgtgcctggatatggtatctgaaactgttactatagatgaaagtatcataagtgagatatcaaccagatgccaaggactttcttcctgtgccatatggagaaaagaatccgctgcctgctgacttctgatcctcctcccagattctcatccgtgccttttggtgtccgcaaaagattcaaaactacacagagctatgtttgttcctacgaagttccactggagggcgcaatatcattactgttaccagctaatagaacgtaacctgttagggctaacatgaataatttacagcgcatttttataagctctcttagtataggccacccaagagagaaaacagttttgtgccttagatgaaaggacaacacaggaaattataacaatggtaacaatccttttcttcatcatcccccaggagtcctggttgcttcctctgcaaatcagtgatggcttatacaaagaacagtattaaagactccgcggctggacgcggtgggtcgcgcctgtaatcccagcactttgggagaccgaggtgagtggatcgcctgaggtcaggagttcaagaccagcctggccaacatggtgaaaccccgactctgctaaaaatacaaaaaattaccccggggcgtggtggcagacaactgtaatcccagctactcgagaggctgaggcaggagaatagcttgaacccaggaggcggaggttgcactgagccgagatcacgccactgcactccagcctgggcaacaagaacaaaactccatctcaataaataaataaataaataaagattctgctaacctgtggcgggtctgtttgggtccctgtgtattctttcctaggaaaagcatgaggattagggttgggccatagggtctcattcctccaagagtaatggaacaccagctgcagcagctccagtctgtagcaagggttcagaacttgtccatgacaaggtctcaaaacccatctttcaagaaaagccaggcttggcccgtggctctgcctgcccatacattattatcatctgccaaatacaatatagtagttgatcaggggacaacttccaggaaaacacagctgcaagtctctctgatatttcatggttcttcaccactagagagtcccagaggtgaaagctctgaggcaggcttccccactttccaggtaactgctatttctgggaacttttagtataccccacctagtgtacaggaacacaaagggaagctgctactttgagcaaagcatccctgtgtgtgggcctctgatgtagctgtcgctttctaatatgtctggtgtgattacgtgtattcattattctactttacaataaccagtataaaacagtatgctttcttttgcttcactctgaccttggacaagtcactcaccctctttgagtcagctttcttattttatagtgcgtggaaatgtcacctatctcacagtctactggaatttgccacagtacctacacatttgtaatagtcatatttttttctttcaacaatatatttcaggtatcaactgtatgcaagacattattctatgcacttgagatacagcagcaaacaagaaagacaagatccccatgcccatgtagcatacattctaaggggcagaaagacagacacagtttaaatatatatatatatttcagacattgataaatgttatgcagaaagtgaagtcagatagcgggatagaatgtgagaaggcatgaaaggagctgcttgagatagaatgtcctttaaagacctgtccaaagatgtgacactgaatgataaggatccagtatgtgaaaacttgggagatccatgtttcagcaagcataatggtcctgaagtgatttgattggcatgttttagggactaaaagaatttcaggctggctggagaatgttggatgagaggaagacttgtaggagatgaagttggaaaggtaatgagtggccagttcacatagtagtgtgaagacatttgaattgtatttcattttcagtgcattgaggaatcactggaagagtttgaaacaacagaaggatgtgatttgactttcattctaagaatctcatgaatggatgaaaatgaaggatcaaaactattttctgaaaatactaaaacaggattggccatttccattgttgttatttgcactaatggtacaaaagcaatgatgggtaaaaccgctagggtcagcacaaatcaaggcagtggcatcaaactacaccacactactgtactagttgtcgaattcctcattgccacatgaaaagaaacatacacacacaccccatacatgcatatatatgtagtcaaatctcaacccttgagtacacatctttttaatattcttgaggatgaacaaaaaagtgaaaatgtactggtaaagaccttctgttcagtaccaaagccagatgattgtctcaaggaaaagaaattgtgtgattatttgagttgctagcttaaccaggggtccccagctcccaggtgggggactggtactggtatgtggcttattaggaactgggccacacagcaggaggtgagtggagggcaagcaagtattatggctgagctcagcctcctgtcaggtcagcagctatgttacattctcataggagcaagaatcttattgctaactgagcatgtgagggacttaggttgcgtgctccttatgagaatctaatgcctgatgataggaagtggaagagtttcatccagacaccatcctcccctcacaaccccatccatggaaaaattgtgttccatgaaaccagtccctggtgccaaaaaggttagggaccgctgagcctaactagctgggattttctcctgtgaattacatttttcttgaaaggaccactgacagacaagctgtggttattcagacgtgggtatgtgaaagatgtcttgaagataaacaaagggagctttgtttcaacaaaaacgacttacagcatttactgccaatgataaaactggactcgaacaaaaattagaatttttggaaaacatgaatctgccatcataagcttgatatctgcacaatacttagagactattcggataatatcagggctattgtcaatgaatgtgactttaaattagtttgtataattctttttaattgattttttattgtggaaaaatatacataacatacagtttcccattttaaccatgttaagtgtagaattcagtggcattacctacacttctcttgttgtacaccatcatctctatccatacccagaatattttatcaaaccacactgaagctctgttcccattaacctataactccccattaccccagctcctggtagaacagaatcataaagatagactatatcatagagatggggggaggagccaagatggccaaataggaagagctctggtctacagctcccagtgtgagccatgcagaagacgggtgatttctgcatttccatctgaggtaccgggttcatctcactagggagtgccagacagtgggcgcaggtcagtgggtgcgtgcaccctacgcgagccgaagcagggcgaggcagtgtctcactcgggaagcgcaaggggtcagggagttccctttcctagtcaaagaaaggggtgagagatggcacctggaaaatcgggtcactcccaccccaatactgcgcttttccaacgggcttaaaaaacgcgcaccaggagattatatcccgcacctggcttggagggtcctacgcccacggagtctcgctgattgctagcacagcagtctgagatcaaactgcaaggcggcagcgaggctgggggaggggtgcccgcaattgcccaggcttgtttaggtaaacaaagcagccagaagctcgaactgggtggagcccaccacaactcaaggaggtctgcctgcctctgtaggctccacctctgggggcagggcacagacaaaaaaaaagacagcagtaacctctgcagacttaaatgtccctgtctgacagctttgaagagagcagtggttctcccagcacgcagctggagatctgagaacggacagactgcctcctcaagtgggtccctgacccctgacccccgagcagcctaactgggaggcaacccccagcaggggcagactgacacctcacacggccgggtactccaacagacctgcagctgagggtcctgtctgttagaaggaaaactaacaaacagaaaggacatccacaccaaaaacccatctgtacatcaccatcatcaaagaccaaaagtagatgaaaccacaaagatggggaaaaaacagagcagaaaaactggaaactctaaaaagcagagtgcctctcctcctccaaaggaacgcagttcctcaccagcaacggaacaaagctggatggagaatgactttgacgagctgagagaagaaggcttcagacgatcagattactccaagctaccagaggacattcaaaacaaaggcaaagaagttgaaaactttgaaaaaaatttagaagaatgtataactagaataaccaatacagagaagtgcttaaaggagctgatggagctgaaaaccaaggcccgagaactacgtgaagaacgcagaagcctcaggagccgatgtgatcaactggaagaaagggtatcagcgatggaagatgaagtgaatgaaatgaagcgagaagggaagtttagagaaaaaagaataaaaaacgaacaaagcctccaagaaatatgggactatgtgaaaagaccaaatctatgtctgattggagtacctgaaagtgacggggagaatggaaccaagttggaaaacactctgcaggatattatccaggagaacttccccaatctagcaaggcaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggggccaatattcaacattcttaaagaaaagaattctcaacccagaatttcatatccagccaaagtaagcttcataagtgaaggagaaataaaatcctttacagacaagcaaatgctgagagattttgtcaccaccaggcctgccctaaaagagctcctgaaggaagcactaaacatggaaaggaacaactggtaccagctgctgcaaaatcatgccaaaatgtaaagaccatcgagactaggaagaaactgcatgaaataatgagcaaaataaccagctaacatcaaaatgacaggaccaaattcacacataacaatattaactttaaatgtaaatggactaaatgctccaattaaaacacacagactggaaaattggataaagagtcaagacccatcagtgtgctgtattcaggaggcccatctcacgtgcagagacacacagaggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggattaattcaacaagaagacctaactatcctaaatatatatgcacccaatacagaagcacccagattcataaagcaagtcctgagtgacctacaaagagacttagactcccacacattaataatgggagactttaacaccccactgtcaaaattagacagatcaatgagacagaaagtcaacaaggatacccaggaattgatctcagctgtgcaccaagcggacctaatagacatctacagaactctccaccccaaatcaacagaatacacatttttttcagcactacaccacgcctattccaaaattgaccacatagttggaagtaaaacacacctcagcaaatgtaaaagaacagaaattataacaaactgtctctcagaccacagtgcaatcaaactagaactcaggattaagaatctcactcaaaaccactcaactacatggaaactgaacaacctgctcctgaatgactactaggcacataacgaaatgaaggcagaaataaagatgttctttgaaaccaatgagaacaaagacacaacataccagaatctctgggacgtattcaaagcagtgtgtagagggaaacatatagcaccaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaactttcaaaaaattaatgaatcctggagctggttttttgaaagaatcaacaaaattgatagaccactagcaagactaataaagaaaaaaagagagaagaatcaaatagacacattaaaaaatgataaaggggatatcaccaccgatcccacagaaatacaaactaccatcagagaatactacaaacacccctatgcaaataaactagaaaatctcgaagaaatggagaaattcctcgacacatacactctcccaagactaaaccaggaagaagttgaatctctgaatagaccaataacaggagctgaaattgaggcaataatcaatagcttaccaaacaaaaagagtccaggaccagatggattcacagccgaattctaccagaggtacaaggaggaactggtaccattccttctgaaactattccaatcaatagaaaaagagggaatcctccctaactcattttatgaggccggcatcatcctgataccaaagctaggcagagacacgaccaaaaaagagaattttagaccaatatccttgatgaacattgatgcaaaaatcctcaataaaatactggcaaaccagcaacacatcaaagagcttatccaccatgatcaagtgggtttcatccctgggatgcaaggctggttcaatatacacaaatcaataaatgtaatccagcatataaacagaaccaaagacaaaaatcacatgactatctcaatagatgcagaaaaggcctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacaacatgattgtatatctagaaaaccccattgtctcagcccaaaatctccttaagctgataagcaactacagcaaagtctcaggatacaaaatcaatgtacaaaaatcacaagcattcttatacaccaacaacagacaaacagagagccaaatcatgagtgaactccattcacaatttcatcaaagagaataaaatacctaggaatccaacttacaagggatgtgaaggacctcttcaaggagaactactaaccactgctcgaggaaataaaagaggatacaaacaaatggaagaacattccatgctcatgggtaggaggaatcaatatcgtgaaagtggccatactgcccaaggtaacttacagattcaatgccatccccatcaagctaccaatgactttcttcacagaattggaaaaaactaaaattcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagccttaaacgttagacctgaaaccataaaaaccctagaagaaaacctaggcattaccattcaggacataggcatgggcaaggacttcatgtctaaaacaccaagagcaatggcaacaaaagccaaaattgacaaatgggatctaattcaactaaagagcttctgcacagcaaaagaaactaccatcagagtgaacaggcaacctacaaaatgggagaaaattttcccaacctactcatctgacaaacggctaatatccagaatctacaatgaactccaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccataatgagataccatctcacaccagttagaatggcaatcattaaaaagtcaggaaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggactataaatcatgctgctataaagacacatgcaagtgtatgtttattgcggcattattcacaatagcaaagacttggaaccaacccaaatgtccaacaatgatagactggattaagaaaatgtggcacatatacaccatggaatactatgcagccataaaaaatgatgagttcatgttctttgtagggacatggatgaaattggaaatcatcattctcagtaaactatcgcaagaacagaaaaccaaacaccgcatattctcactcataggtgggaattgaacaatgagaacatatggacacaggaaggggaacatcacactctggggcctgttgtggggtgggggaggggggagggatagcattgggagatatatctaatgctaaatgacgagttagtgggtgcagcgcaccagcatggcacatgtatacatatgtaactaaccttcacattgtgcacatgtaccctaaaacttaaagtataataataataaataaaaaaagaatatatcatagagatatattctatctctatgaatttgattgttctaggtgcctcatataaggtaaatcattctatttttttgtgactactttattttattatgttttcaaggttcattcatgttgtagtatgcatcagaatttcgttccttcctaaggcagaataatattctattgtatgtataaactacatttgatttgatttttattctaagaatctcatgggtggataaaaataaagagatctatctggtcaaatgtattttcttaaaatactaaaacattattgcgcatttccattgtgttgtcatttgcgttgatgcaaaagcagtggtgagtaaaatcattttgtttattcattcatccatccacagacattaggattgtttctaccttttggctattgtgaaaaatgctgctatgaacattggtatacaaagatttttacaagtctgtgttttcaattctttgcggtatatgcccagagctgcaacatggtaattctatgtttaaatgtttgaggaaccaccataatattttccatagcaactgcaccattttatattcccaacagcaatgaggcactgttacaaagtagccacttccttaccaacactccgtattttccctttttgtttttgataatagccatcctaatgagtatgaagtgatatctcattgtgattttgatttgcacttccctaatgactagtgatgttgagtatcttttcatgtattttttttttggtgtagcttctttggagaagtgtctattcaagcacttcgcttatttttgactgagttatttgttgttgttgactataagagtattttatgtagtctggatattaatctcttatctgatatatgatttacaaatattctcccctattttatgggttttgttttcattctcttgatagtattcgttttttgttttttttgttgttgttgttgttgttgttgttgttgttttagacagagtcttgctctggtgcccaggctggagcacagtggcacgatcttggctcactgcaacttccacctcccaggttcaagcgattctcctgcctcagcctcccgagtagctgggattacaggcatgtaccacaatgcctggctaatttttgtatttttagtagagatggggtttcaccatgttggctaggctggtctcaaactcctgacctgaagtgatccacccgcctcagcctcccaaagtgctggaattacaggcatgagccactgtgcctggcttcttgatagtatttgtgatgtgcaaaagtttataattttgatgaagtccaatatatctattttttcctttgttgcctgtgctcttagtatcatatctaagacatcactgccaaatttattgtcatgaagtttttctcctatgttttcttctacaagttttatagttttagcacttaacatttagatctttgatccattttgaattttgtctaatgttaggttttgtctgattaatgtaattttgtccaatatcaatattacctctcctactctcttttgcttattattcttgcttattatttttatggaatatcttttgtgatcatttcacttctaaactatgcatgccctaggtttaaagtgagtttctggtagacagtatatagttagatcctggtttttttttcctttgtattcaatttttaagtttttgttttatggtgtttggtttgtttgttttttgagacagggtcccgttggctctgtcacccaggccagatggcgcaatcgcggctcactgcaacctccacccacctcgccccctccccggagtcaagtaatcctcccacctaagcctcctgagtagctgggactacaggtgcgtgccaccatgcctggctaatttttttttctttttttagagatggggatttgccatgttgccccagatggtctcgaactcctagactcaagcgatcccctgtccttagcctcccaaagtgctgggattacaggcgtgagccactgggtccggctgttttacgggttttttaatttcagtttttcttttagatacagagagtacatgcacaagtttgttatatgggtatattgcacctagctagtgagtatagtacccaaataagtagtttttcaactcacagtcttcctctagccttctccctctagtagtctgtggtgtctgcttttctcacatttatgtccatgtgtgctcaatgtttagctcttacttatgagaacatgcagtatttgggtttctgttcctgcattaaggtgcttaggattacggcctccagctccattcatgttgctgcaaagtacatgaaacatgatttcactctttttatggctgtgtagtatttcatggtgtatatgcaccatattttctttgtttggtccaacattgatgggccccagagttgattctgcgtctttgctattgtgaacagcacagcgatgaacacatgagggcatgtgacttttttctataatgatctattttcctttggatattatattagtctgttcttgcattgctataaagaaatacccaagactgggtaatttataacgaaaggagttttattttatttttctgtaggctgtacaagaagcataacactggcatctgcttctggggaggcctccagatcttacaagaagtcactcactatcttgagtacagtaccaagagggatggtaccaaaccattcataagagatccacccccatgatccaattacctcccatcaggctccacctccaacactgtggattacatttcaatatgagactttgatagggacacatccaaactatatcaggtatattcccagtaatgggattgatgagttgaaccgtaactctttttaaagttctttgagaatagatcctgttttttaatacatcctgccaatctaagtcttttccttgacaagtttgatccacttacattttaggtaattactgatagggaaagatttagtaattccatgtttacctgtttttgtatgtcttacagctttccggtttctcatttctgtccttactgcctttttgtgtgtttgattaattttttttgtagtgatgcattttgattcccttctgatttccatttgtgtatattttgtagatattttctttgtggttactaggggaattacatacaacatcctaaaactagagcagtctattttaaatttataacaattatttgaagtagaaatgtgttaaatcccaagaatttgccccctggagatgcagccttgtgatttttcacatttatttgcgctggctttggctgttaatggaaatgtttctcaatagtttatcaattcacattttctacccaatataagaaagactttatcttactatttttaaagtggtcaattagattttgaaatcactgccttacaggacagttcactgaaatggtaagagtgtagctactgtggttgaaaattctctggatgaattattaaaatcctaaccaggataggattcatttgtactgagtgctcattgtgtgccaatcgtggaagcatagaaaatatgttgatggtggccatctcagtattgattcaattatttctgaagagatacatgtttaaaaaaaattttttttgagatggagtcttgctctgtcacccaggctggagtacaattgtgtgatctctgctcactgcaacctccacctcctgggctcaagtgattctcctgcctcagcctcccaagtatctgggattacaggcacgcgctaccacacccagctaatttttttgtatttttagtagaaatgggatttcaccgtgttggccaggctggtctcgaactcctgacctcaggtaatccatgcgtcttggcctcccaaagtcctgggattacaggtgtaagccactgtccccggctatggttaaactttatgttaacaggatttccattaaactgtctgacacatacatattgttcaaatatagttattgaacagataattttatgcaggatttgcttattcagtcagcatttatgaaacatataatatgtgtctgaaactgtcctgggcacacaggattcacaaatacattagacaggtttattgcttttcataggcttgtagtccaaaggcaagttcagccatctaaacacatataatgtataatcttctattaaggtctgaatagaaatctttccttcatgttcgctctagcttccaggatatcatacatgttgttcctattccttcttctaggacaattcttaccctttctcttaaacagataactctttctgagtccttctgaggatacaacttacaaatcactacctccatgaagcttcagaatcttccccactaccaaaccatcatcctgtcaactgtcaggagatcccaaattcccctatcataataaacatttatatcacagcttgttgcagtttcttgtgttactttatgttgcttccaatagacagtgagctccagaacattctcactatctaccttactcattgtcttactacttatctcagaccttagtacagtacctgacataacaggtgtgaggaaagatactaccatagctagatgtttcaggccatagaatgggaaataaaatagagccaaaataatctgccaacatcatctaatcttagatgagaaggcacagctaaagattttgcacttttactgaatggaatatattttaatacctttattgagatataattcacatactgtaaacttcacatgtttaagttgtcaatttgagaagttttgaagcttgcatgcatctgtgaaaacaccaaaataaaggtaataaagacatctatcatcaccaagagtttccttatggttctttgtagtctatacccctcacctctatttctagcctgctctgatcccagccccagataatcacttatgggctctttgtttgtataaattggttggcattttctagaatttcatataaatggaatcaaacagtgtgtcctcttttatctggcatcttttcctcaccataattattgtaatgatgttgttccacataacaaaaattcactcattttatttttgagtagtatttaattgtgcagatgtactacatttccctcatctgttgatgtttctagtttgcagctactaaaataaagctggtatgagtatttaaatgtacatgttcgttcacatggtaaataggtactttcattactcttggctaaatacccagagttgtaaagtctggattatatgataggtattggtataacttttttaaaaactgccaaaccttttaccaaagtggttgtaacattttataattcacaaacaatgtttgagagctcctgtttcttcacatcctcaggaacacttgatgtggtcaggatttgtagtttgagatactctaataaatgtagaatggtatgtctttgtgttggaatttccattttcctaatgactaatgatgttgagcattttatgtgctcatttgccattcatatatcttcttaagtaaagcatctgttcattttttcccatttaaaaaattggattgcttgttctcttattattgagttttgatagtttcttatgtatactagatacaagtcctttattaggtatgtgattttctaatacttcctctagttctgtggcttaccctttctttcatttaatgatgtcttttgaaggacagaagttcttagttttaatgaattccaatttgtcacttttcttttatcaagttttttgagtttcatataagaaattgttgcctactgtatggtcacaaagatttttccatattttcttctagaagtgtacagctttgcattttacatttacatgtgtgatccaattaatttttatatagcatgtgctgcatgggtatagacagcaggttcttccagcactagttattgaagagatatcctttttgcactgaattacctttgcacctttgttgaaatacaattggacatacatgtgtggtctattgctgatgtctattctattcattttttgcctatatttttgcccatattggtaccattactatactatctttattagtgtagctttctactgtaaattgtccaaatttgttctttttaaaagtcattttggctattttgcatcctttgtaatttcatttgaaatttagaattagctacaaaatagtctgttggagtatttatttaatctgtgtttcagatcagttcagggattaacaaaatcgagtcttccacataaatatgacgtaactatccatttatttagatcatcctcaaaaatatctcagtacaattttcagtgtatagattttgccaccttttgtgagatttatccctaagtatttcatgtttttaatgttatcatgctggtatttttatttaaatatcaaattgtttgttagtaatatatagaacggcaagtgatttttatagatatagcaagggggttttttgcagattctataggattattttatagagatgatcacatcttcatagacaaaagagacagttttacttaccgctttccaagtttttcttctgacccttttattaacattttttcttgtattattgcactagttagattaagcggtggacaacatatttgcccacttttttttcattttaagaggtaagtactcagtcttcatcactacatttcaagttacctgtaggtttttcatagatgccatttccttatcaagttgaggaagattgcttctgtttctagtttggtaagagttttaccaggaatgaatgctggatttgccaaatgatgtttctgcgtctattaaaatgactattttacaaatctgttaatattgtgaattacattgatttgtttttctaaggttaaactacctttgcattctttggtcatgatgcattatccttttccccaggtaatactggcttcgtacaatgagtcaggaaatattccatttctttaattttctggaaaaaaaattctgtgggtggcattatttcttccttatatgattagtagaatccacaagtaaatccatctgggcctttaattttctttgtggaagttttaaagtagaagcttaatgtattgaagagtgttttaatcacctcctatttatcccattagtgagggagggattcctgcctaggtttaggcaaatggctggcgtatgacacgacaccggacacatgagactgttagcaatttattagtaatgtatactcacaacctgagagaggaggataccatgcaccatacagtgacatatgaagtgttgcactcagaaataaagtggaaaaccagggcctgtgaaaggcagagtttgtagtattgttaaagtgccccaggttcacatgggaggatgtgattggcttgtttcagtaattctatagcctgacagagaactaagacctgctactcagagacgagcaggaactgcatctgttctgctcaataaggaggattgcttgcctagggaaccttatccatgggagcagagagggaagggaacttgtggatttaccattcaagatccttccaatttcaccacgtatcaaggtaatacacaatattggaccttaattttaggcctcacaccacaaatggatacagagctagtcagattatctatttcttctcaactagctgttgtctttcaatgaatttctctactttattcaagttattaaatgtgttgacatatagtttttttaaataatgtttccctatttttttttttttttttgagacagagtctcacactgtcgcctgggctggagtgcaatggcgtaatctcagctcgctgcaacctctgcctcctgggttcaagtgattctcctgcctcagcctcccaagtagctgggattacaggcgcccgccaccatgcccagataattttttgtatttttagtagagacggggtttcaccatgttggtcaggctggtctcaaactcctgacctcgtgatcctcccgcctcggcctcccaaagtgctgggattacaggcgtgaaccaccgtgcccggcctctattttttaatatctgtagaatctatggtgatatcacacttctcattcctgatcttgataatttttgtcttctctcttactttcctgatcaatctggctaaagatgaatcaatatttttatcttctcaaaaacctagcttttggttaaatggttttctctattgtttttctattatttcattgatttcttatctgacttttgctattttttattctccttaagctgagttttatttgattttttttttttttttgatatgaagtctcactctgttgcccaggctggagtgcagtggtgtgctctcggctcattgcaacctccacctcctgggttcaagcacttctcctgcctcagcctcccgagtagctgggattacaggcgcctgccaccatgcctggctaatttttgtatttttagtagagacgggatttcaccatgttggccaggctagtctcgaactcctgacctcaagtgatctgcctgcctcagcctcccaaagtgctgggattacaggcatcagccaccgcacccagcctttatttgacctttatattgcttcttaagatggaacttgatgttattagtttgagattttgtttaaataacatcgagtgctgtaaattctaatctaagtactgctctagctgcatcccagaaatgtaaacatgttttggataaattgttattcatttcaagataatttatgattatccttttgatttgttcttgtggctcatgggttacttagaagtatgatgtttagttttcaatgtaaattttcagaatatctttttgttattgatttctaattcaattccatttcagtcagagaatatactttctgctatttcaaaactttttaatttattgagacttgtttatggcctattatttaaacattccatatatgcttgagaataacgtgtattctgtagttgtttggttcagcattgtaaaaatgtcaataggttagtttggttgaacctgttgttcaagtcttctatatccttactgaatttctttgcacttgttctatcagtttttttgagaggaggtgttgacatctctattattattgtggacgtgtctatgattacggtataatcaattagtcagttctttatgtattttgagttctgttaataagtacatatttagaattattatatccccttgaagaattgagctctttatcatgatgaaatgactctccttatcccagataatattcattgctctgacatctactttgtttgaaattaatatagtcactccagcattattttgatgactgattgcatgatatacattttccatcctattacttttaaccttttatatcatttataaattaagtggatttatgtaggcatcatattgtatttccttttttttaatcttatgacaatcccagtcttttaattgggatatttatatcatttaatatgtaatgctattgatacgctttggtttaagtcacccatcttgctactggttttctgttgttcgcatctactctttgtattatactcctttcttattttttaatttgtacaaatatgtacaaaatagtcttatatatttatgggatacatgagatattttgatatgggcatgcaatgcatgatcatcacatagtgggaaatggggtgtccaacccctcaagcatttaccctttgtgttacaaacaatccttttatactcttttaactatttttaaatgtacaattaaattattattgactatagtcaccctcttgtgctatcaaatactaggtcttattcattcttcctaactacttttttgtacccactaacaattgccacctccccatgccaccctactaccattcacagtctctggtagccatccttctactctctgtctccatgaggtcaattgttttgattttcagatcccacaaataagtgaggacatatgttgtttgtctttctatgcctgatttatttcatttaataaaatgacctctagttccattcatgttgtttcaaatgacagaatctcattctcttttatggctgaatagtagttcattgtgtatacgtactccattttctttatcttttcgtctgttgatggacactaaggttgcttccaaatcctggctattgtgaacagtgcttcaacaaagtaggagtgcagataatcactttgatatattgatatcttatcttttgggtatatatccagcagtgggattgctggttcataaggtagctctatttttagttttttgaggaacctccaaactattctccatagtggctgtactaatgtatattccaaccaacagtgtacaagggttccctttgctctacatccttgccagcatccattatttcctgtgttttgaataaaagccactttaactagggtgagatgatatctcattgtggttttgatttgcatttctctgatgatcagtgatgttgagcaccttttcctatgcctgtttgccatttgcatgtcttcttttgagaaatgtctattcagatcatttgtccatttttagattagatttttttcctacagatctgtttgagctcattatatattctggttattaatccattgtcagatgggtaatttgcaaatattatctcctattccattctgtgggttggctcttcactttgttgattgttttcattgctgtacagaagctttctaacttgatatcatcccatttgttcatttttgctttggttgtctgtgcttattgggtattattcaagaaatttttgcccagagaaatgtcctggagagtttccccaatgttttcttgtagtactttcatagtttgaggttttagatttaagcgtttaatccattttgattatatttttgtatatggcaagagatagtggtctggtgtcactcttctgcatgtgaatatccagttttccctgcaccacttatggaagagactgtcttttccccagtgtatgttcttggcatgttttttgaaaatgagtgccctgtagctgtgtggattgattctgggttctctgtaccaaagaagaacaaagttggagaactaacactatcctacttcaagacttatataaagatacaataaccaagacagtgtgttactggcaaaagaatagaaaaatagatcaatggaacagagtagagagcccacaaatagacccaccctaatatagtcaactcgtctttcacaaaggaggaaaggcaattcaatggggaaattatgatcttttcaacaaatggtgctcaaaactgcacatccacctggggaaaaaatgaacctatacacagacattatgcctttcacaaaaattagctccaaatggatagtagacataaatataaaatgcaaacctataaaactcttagaagatagcatagaagaaaatttaggtgaccttggcttggtgatgacttagatacaacacaaaaacacagttcataaaagggaaaattgctaagctggacttcattaaaattaaaatgctctgttctgtaaaaaaagatgctgttaagataatgaaaacacaagtcaaagactgggaatatatttttgcaatatagtatcaaagggctagcataaaaaatatacaaagaattcttaaaactcaacaataagaaaataacaacatgattggaaaattgtcaaaagatctggaaaggctacatactgtatgattccaactatatgacattctggaaagagcaaaactgtagagacagtgaaaagaccagtgctttcaaaggattcccagggtgggaagaagggatgaattggtggaatgtaggtaatttttagggcagtgaaattgttatttcatgcgatagtgtaaaggtgaacaaatatcctacttttgtcaaaagccatagaagatacaacacaaagagtcaactctaatgtaaactatagactttagttaacaataatgtgttaatattgattcatcaagtgtaccatattaatgtaagttattaaaaataagggaaattgggtgagggtagagatatataggaattctgtgtactttttctcatttttctctgtacacctaaaacttctccaaaaaattaaatctattacttttaaaaaatatatgaagtcatggactgggaatataaaacaataatttccaagatattggacatgaagcaatgaaagagagtaatctgaggagatgagaaacaaattgagtgacatgtatttaaaaattctattaaacatgctcaatctctccctcaagcttcccgaacatatggaatagtgataataaccattttaatatccttgtctagtaattctaccatttgtgtcattctcaatttgtttccattgaatgcattttctctgcattaacagttgtattttcctgcttgcttttatagataagaaccattttatagataagaaaaccgagatcccaaatggtttattgacttgtttgacattgggctccccatctgtgtgctcctgcgggatcctgtactttgcctacctgtgcccctgtcacgtagtgttgaatggaaaaagctatctctgtttctcacacaatacattgagagatgttaagatctagagaaaataggaacttaatagaaccaagaggcctatattcttctctcctcctacctttttgtagctatgagaccttatcttctcatattgaccagatattgttaattctgattagttgaataataactatttttatatgtctgtagttttcctttttgttctcagatgtgattaagaaatttagaaactattaatattttataatttcaggttttatttttatgctggattagatatgagcagagtgatgttcactctgggaataattttcttccattcccaaagcaaagccttttgagtacattgcttgatgctctgtgaattgtgagcttttccactgtagctggtgggagtcacattccccaccctgtgtgagcttaattctatttaaccctttcagatggctttttccctaacctctagtagtcttatatgcaaacctctgtaccacttacttaaatactcaaagggaaatctctacaaaggtccaaagttctcgctctgtgcagctctctcctctctaacactctgccttgaaaactagagccaccttgactcccctacaatgtactccgcacagggagaccaccaagctctgcctgggttaccctttcctacagtaaactgaggcagtcatgttactcaatttgtttttgtttctcacctcttcagattactctttcactgctttatgttcaatatcttagaagttttcgtttcatgtatgctgcctagtttatttcattgcttcagggggaaaggtaaatctggtagccttttctgcatctttaccagaaatagaatctcatgaaacataatttttaatatcccatatttagcacgatcctattcagactaagaaaaagaaaatgggaaagagaatcttcatcaaagattttctagaaaagatttttgaatacccaagaagttatactaagttaagacggtcactctttttctattggacactgttgtacttgcatgtgatcctgaaacactttttgtagacatgctaatcctaactgggatatctctctgatgctgacagcaagctctcagggccttctacaggcaggaatctgccaccttgtaatgatgagggtttatctcagagaccatgttgtcataatttggctttccccagtgggtaccttcaactccttcgggctgttgacagttcctccaatgtccactcgtgggtgtgaagtcaatgttggttacatcttttacagcctgacccatgagaatagatttcattcacttcaaatctattattataagtgagagacaggaatgacatcaaccccccaccccaacctcacacctcatgcttgttccccgtgcttcctacatttggaagagcatgaagactgcgatagtgtctcagagccaagtctgagaaactgtgaaggaatctcgaaacttgtgccattcagagaaaaaccttgatctcctggtcacgatgggggaggggaaagatattggggtaactcactgacagatttactgctgagacccaagcagaaccaataaggtctagattttttttggtccaaatatctgggtataataacataagttacattagtaacaatatgtgacatttgatgacaatttgacacatcagggcatggagctctgtattcttccagcacttcacttaaaatactcaataaattaaaagatatgtagttctataaccattttatagataaggaaaccgagaccccaaatggtttattgacttgtttgacaatggactccccatctgtgtgctcctgctggatcctgtactttgcctacctgtgccccgtcacgtagtgttgaatggaaaaagctatctctgtttctcacacagtatattgggagatgttaggatctagagaaaataggaacttaatagaaccaagaggcctatattcttctctcctcctacctttttgtagctatgagaccttatcttctgaattgcttttttacttagttttaatgtcaaggaaacgtgggggacggctcctgagatagtggttctcaaagtactgcctacacctcaagctgtgtacagttgagacaaaagctgcctttgaatttttgctctaacagcaacagtaaaaataaaaagagctcacatgcagtattattttttaaaggtgcattgcctcatttaagcctcacagagacaatgagtgcacgtttttaaacacgttacaaattcagataacaataagtgacagatttgaggcacaaatcaaagtaaatgaatgtcagttcaaagcctctttcttcaaaataagtgtttcccaaactgaaatgtgaggatcatagtaattctgtaaatttaaacccgggataaagtataaagtttatttttaaaaagcatgttggtaccctgttgtagtagtttcagtcatcttgaggctctctagatagctatgccttcagatataaaatgtaatttgctttaaaaactattttttaaaatggctgacttctccctagatttggcaaaacaaaacaaaacaaaacatataagtatagattcaaggaaataagtgaaccccaaatttggtaatccaaagtaatccatgctaaagcacatgatatttaaacttctgaaacctcaagacaaaaaaaaatcaagaaacaaagcacacaaatatgatacattacttataggggaacataaattctagtgacggcagatttctctttcaaagcatggaggaaagaaggaagtgacatgacatttgttcgtgttcttgaagaataagttgacaagtgcaaatttcgtatctggagatattatctttcagaaatgaaaggagaataacgacatactcagaacaagaaaaactaagataccgtgtcactggcagacctacacttaaagaatggctaaaagaagctcttaaaaaagaaagaaaggcataactgaaaaaagctggaaacataagaaaggaaaaaagaaaaaaatgaataaatggaaataggattaaataatataagctacacttctcttcatgagcttctttgatcatgcttgacggttcaagcaaaaattataacatttgttttagtgttcaatccgtgtcagaaagtacttgagacaattatatttttaaagctaggaaagtgtacagacctaaatggaactttctatacttcatgcaaaagcataaaatatcaatacctatagatggtggttaaatatatatatctagagtagttacttaaaaaaaaagattcaaagtgatatacctaaacgtattataaagaaatggaaggggaattctttttttttttttttttttttttttgagatggagtctggctctgttgcccaggctggagtgcagtggcgcgatctcggctcactactacaacctccacctcccgggttcaagcgattccggaaggggaattctaaaacgtttccaagtaactgcatctccaaaaaaaaaaaaaggtctgtaaaactcataaaccttgggtgagacttatgaagataaaaggagtaagacacaaattggtaatatcaagaatcaatactgggaggcacatcgctagagaacttcatgccaataaattgaaaatttagaagtggacaaaccaggcaagctggctcatgcctgtactcccaccactttgggaggccgaggctggtggatcatgaggtcaggagttcaagaccagcctggccaagatggtgaaactccgtttctactaaaaatacaaaaattagctgattagctgagtgtggtggcgggcacctgtaatcccatctactatggaggctgaggcaggagaatcacttgaaccctggaggcggaggatgcagtgagctgacatcatgccactgcactccagcctgagccacagagcaagattcgtctgaaaaaaaaagaaaagaaaagaaaaaaaaaaagaagtggacaaacagtaaaatacttaaaatactgaaaacttaaaatactgaaacctgagagaatacgttaaaacatgatttcatctgtaaatgcgaaataaatgcaatcagtaattaaatacttttgacaaaaaaatctctagttccagatggttcataaatgagttctgtcaatgcttaatgtgagagatcactccaatactgcacaactttttcagagaatagagctagcgagtacactaccccttgtgttttaccaagtgaaccttgacacagaaactagataaggataatttaagaatggcaaatttcaaagcaatctgtctcagaaacatacgtgaaaatatcacatgcaaggtacttgtttaaaaagctagcaatatctttttatttttagttttagtttttttttttttttttgagatggagtttccctcatgttacctaggctgaagtgcaatggcacgaacttggctcactgcaacctctgcctctcaggttcaagcaattctcttgcctcagcctcgcaagtagctgggattacaggcgtgcgccaccatgctgggttaatttttgtatttttagtagagaaggggtttcaccatgatggtcaggctagtctcaaactcctgacctcaggtgatttgccctccttggcctcccaaagtgctgggatcacaggcgagaggcgcctggcctctagcaattttattttaaaagatactataaaagtataaaaatttttgaaaaaaaagatagtacatgacgtgatttggatgtctgtgcccactgaagtctcatgttcaattctaatccattgtgtgaagatggggcctggtgggaggtgactggattgtggggaccgagttctcataaatggtgtagcaccatccccttggtgcttttctcctgatagtgagttatcaggagacctggtcctttaagtgtgtagcaccacctcctaatctgtcttcctcctgctccagccttgtatagaggtgcctgcttcctcttggccttgggacatgattgtaagttttctgaggcgtccccagaaacagaagcccctatgcttcttgtgcagcctgtaaaaccatgagccagttaaacctctttcttttataaattacccagtctcaggtatttctttatagcagtgtgagaacagactaatacgctatattatgaccaagttatatttattctagcaaagcaaggttggtttaacattagaaaagaaatgaatgtaattcaccacttgaacagattaaagggaagaactaaactaaatgtgaccacctcaatagatacaagaaaataatttggtaaaagtcatcattcattcatgatgaaacaacctgtggaaaagacggaatctatgagcctctccgagagagtttcagatgcagtgttgcagttgacagtctttggaggtatgtcacaacaccggaattcctactaggaagaggtaataagtttaagtgcatgaagactagaagaagatactgcaagctaaatccacctaaagtaaagataaaattcaagaagcaaagttgaaaagtgcttgccaatcatatcgcagacaaagggtggatttccctaataagtaaataccatcagtggattcattttttgaaaaaaggaactaagcctactctattgtcattgataacgctagctgctgtaacagatgaactccaacctcttagtggcctaacactatgaacatttttcttgcctacatttttccaaaaggaaacaggactggggagggttggctcttctttttgaaaacaatctaggaccaggctgacagaagctctgccatcttcaacacctggctctataagtcgctctgggtgtcaacatctttccagcagatggggaagaaagagtaggaggatctcataggaggtttttatgaatcatgcttgggagaattgccactcgggcccaccatccattgcccaggcctcagtccaccagccacagttacctgccaggaggctgggaaaccccaggaggaaaagaaaacaggtctggaggacagctagtcagtctctgtatatgtatgcctgaacagttcacagaaagaaaaacacaaaaagctcccaaatgtatataaaacttcccagcctcactcctaataagagaaatgggtttctgaagcacaataaaatactgtccaggatctatcctatggacagatatgcaaatgtttgaaacagactgatttggtgaggatatgggaagagtcacattcctgcattgttagtatgggtgtaacttgatgtaacacctagagaaggcaatttagcagtatctgtccacattgtgtgtgctttacccccctcctccagaaatcctgctgctatgaatttgtcctttggatgtacttgcacttgtatggaatgatataacatgttagtttactcgatgcggtattgtctgtaatagcctaagcctgggcaaacccctgtgtcaacagggcaccggctaaataaagaaaaggatatatccgtatcaaaggataccatgcaggcatggcatagagcagaatgcttttacctctgtggagctacactgcatgggtgcaaatcctggttcttccctcgtttagaagtattacctacggcaagtaatgtcaattgcatgtgctcttcactcctcatgcacaaaatgaggaaagcacctacttccctaggttttggtgaggatgagtttaattgatttgaagcatttacagcaatggcatagcaagcacgctataacttttgcctgtattaagcacagaaagtactccaggatacattctttttcttttctttcttttttttttttttttgacggagttttgctcttgttgcccaggatggagtgcaatggcacgatctcaggtcaccacaacctctgcctcccgggttcaagtgattctcctgcctcagcctcccgagtagctgggattgcaggcgtgtgccaccatgcaaggctaattttgtatttttagtagagacggggtttttccatgttggtcaggttggtctcgaactcccgacctcagatgatccacccacctcggactcccaaagtgctgggattacaggcatgagccaccgcactcagctccaggagacattctgagatggaaaaaatgccaggtcaacacagcgtttggtacacgccttaatacagaaagaggagtttggatgatgtatatgcctgaataccagtgatgttcctccagaagggtatctaaaagcctggtgggaaagaggagtggcctttgggaatgagttctggatggttcagcaatggaggtgagaagaatccgttgcctgcacatagtttagaaactttggaattttacaccaagtgtgcatgtatcacctattccatttcttaatctttgctaaaggaaagaacagaaaagaaaaaaaaaaataacaggctttggagctatgcaagcctgaatttgtgacccttctctactaagcaggtcaaacgatataaggagggacctcatataacaggagcatgtggggtccactgttcagaagcagcaaaatctcactttcttttctgactcaatctctgttttgacctctcaggatttttgtagttgtaatttaatgtggtgctgcctcagttaaggggacacgcatagggtgagtggagatcctcccaggtgtccagagccctgccctgtggcttggcattcccaccctgcccctccctgcacccacacccaggccttctcctgagggtgaagtgcagcagcagtcgctgggttggcagagggaaggggagtctgagagggtgggtgggtgattgggcagcagagaacctgtcccagtgaggcctggaggtggtggaagctggaccacatgatagctgaggctccaggaccccagcacacactgcaccgtttcatcacacctcacctaccaagcacaaattcaaggaaagaaatagttaagaatttcaagacagccacactaaaccgcaagcccagggacccattctgagcatggagccgtgtgggaccactttagttgcagtttcgtgaaactggccgtgctaccacatgttacttgtgtgcaatgacctaacttctctgtggcctcagtttcctcatcagtgatatagatattgaaaaaaccatatagggtttttgtaagactcaaataacatactacgtgctaagtacttagcaaagcatgtggcatggtataagtctcgacatgtcaagtaaaattattgtaagccggaaataaaattctaaggctcccaaccatctgagtgtttcataggtaaacgttgtagcattttcatttgcccttgttccaccttctccctgacctggtggcggcattgcacccagcagcctgcatcccacgtgtggaaccctggtacctggttccggaaggagagagcagagcttatgcaaaaatcatggttttcattggttctaacccgtccaggggcttcctgaaggacagaagcaaaatgctcctctctgtttgacctaacagggaagtcagggcagaaaaagcttgggcagctcctgaaaaccttataaggcaaatcaaaaaacggcaactgcgtgaggcagaaactacagttgaaacctatagcagataacccaaaacctgggggatacgctggcggacaggccatttgggaaattagatcattcggaagcagtcatgtaccctggggattgtcaaaagccaggtgcgtgcccaggattggatgcatgctcaggaaagacccgagaagaccctaagctttcaccggctgatctctggactcagtctaaacaggaagtgacagccaagacagagttgtaagtggcctggctgaggtttgaaggagtgctgcagcccagagcgaatccacaaaggctgacagaggaactttttgctttttttttttttattaagctctgggctgtcaaggaaattgctgtcaaaatacaagcagaaaacaaactaaaggaacagagagttcagtggccacatgtgacaacgaatgcaggctctcccaaaagagtttggaaaaccctctagacaaatcaatgactgcagctttcagaaatcagcaactgcaaatcctggagaaggtagaggatctaatattcagtgttaccacattaccacaatcaaagacctagttttcagcagcaacaaaagaatccaaaagcctacaagggaacttgaaagtatggcccattcaaaggaaaattgcaaactgacaactcaatggtagtttctcaaaaagaagagtgtttcctcctgttcatagagttggagctataaaatgatatgaggacagaacattccattgtgctcaacattatgaacaccatggtgacctttgagagagccatttcattgggatttgggggaaaagaatgagttgtaggatgaataggtgatgaagtaatgacaagtgtggagagctccaagtttcattgtgaatggaaggagatgaggtagtgggtgcagggtaaaatggagaagacggagggtgctttgagcgtttgattgttgatttttaccattataaggttttcatgaccagtgcgtgatttagtgctattggaaagatatatttggaagggcaggttgaagttgacaggggcaatcaggggagtaaatggatgatggatgctataagattcctgggaagataggagcagtgagattcaaagcacacattgaaggatcacccggaaagagcaggagggatgttctgtcataaatggaggaaaggcaacaacttgtacctgtacatgcaggtaggtgtttacaattgctggtaggaaatggagagagtccttcctgaggtcttggattttctcaggaaaataggaggtgcggccagcttctgagaatgagggaaaggagatcaggggtttccagagtcgtacagttgtgtaataaatggtcattacaggtagttggagagagagctggttgggaaaatacagtagactaactgacccccatatagggcttggttgaggttgatgtctacgattgtccgtggtactggtctccggactcatctgacttttccccagtcttctgctgtttcttgacttcaggcctaagttcatccggtctttggtaagggaacgtttctgggttggatgactgagcaatgctagagtactcagttgaagcattaaatacaggggcgtgcacacatttgcaggtgaggggagtgcactgagagatagatctgcgtttgaggtgcttgtgaaaacatccaggatgtacagaaggcaactggatgtttcagtgtggtgctcagcaattactttcagaccaggaatacacgtttgtgaatcctctcaacaatcagtcaggcgaagccaggagcgtgagttaattcaccccaggatgtaggcaagatagcctgtaaagagctggccgaggaccaaacctagggaatagtaacactgaagaacacagggaaacagaagtccaggaaggagatggagagagaaatctccgaggaataggatagtaactaggagaaaaagtagtaccacagacgtgaaggaaggagggagggttatgctgtggagatgtaaggccagatcataagggagagaggagtccattgggattcattagttaggacatccttgttaccttatggacagctcggggttgggacagctcgggggcccacgtgaatgaagacagactacatgaaattgaagagtgaggaagagaagtccagggtacttcatttaaaaggaaatgaggaagagtttggtaggtagagcggaagacaaaggaaggttatttaggttgaaggatacttgaatacatttttagaatcaggagaaggagaccttagaaagggagaaagtgaaaatgcaggagtgacaaactccatttttatcattctaatctcttattctcagagcaaccctccagggaaggtagtagtatcgctgtggcagcgatgcagagttggcagaggtgagacaactgcaagggagaatttcagtcactcgcctgtggtcacacagctagtaagtgggatccgggacttgaacacagttataactccaaaatggttgcactcaccagggtaacttgtcacagataccttgaaccttgttctttcttggaaaaaaaaaaaaaaaagaaattgacatactagactcagtacattgtttaaacatttaccttcttaaagaatcctccccgtactctagtaagtaatatgagtttcacccttcctggagtggctgttaatcccaggcactcagttgaatgtttcatattcattgttatttaattcccacaatgtcatgtcaaagtagaagtaattacctcaaagatgaggaaatgaagtttcacagcggtcacagctcttgccaaactacacgttaaccattgatttctgcttctcatctcccaaaaatacatcaggttatcagtgcttttcaaaagtctcaaccaattagtggacatgaatgttactcatgtacatttggaaataaatagaggtaagtgtacataaagtggacgataaatggtagttttgaaaaaagactttgttggcatataatccacaggccataatcttcacccatttcaagtgtacaattcaggtgtttttcttttcattctgcatattcacaaggttctgcaaccatcaccacaatctcattttagaaccttataatcaccttggaaagaagccccatacacattaacagtcacttcccaccctgttctccttctccaagcaaatggaaatcaaatttcttagtccataagtttacatatactggacgtttttccaaatggaatcacataatatgtggtcttttgtgattttctttcatgcagcatcacgtgttctaggctcacgcatgttatggcatgtatcagtatttcatccctttttgttgccaagccacactcccctgaatggagaaactaaattccatccgtcagttcatcaactgatggacgcctgcgccactcgcaatctttgaccactaggaataatgataccgtgtatgtttgtgtacaggtttttgtttggacatagagtttcatttctcttttgtagaaagctaagagtggacctcctgggccatatggaaattgtgtttctggtactgaggagcagccaaattctttcaaaccaggctgccctatatgttatagtcccactagcagtgtatgaggactccaatctctccacatccttgtcagcagttgttatcgcctgtcttttttattcttgtcatcctactgagtgtgaagtggtagctcattgtggttttgatttgcatttccctactggctaatgatgattgtgggtggcttttcgtgtgcctattggccatttgtgtactttctttggcaaaatgtctattcagattctttgctcctttttgaattaggtcatcatttgactgttgattcatcagagtcctttgtatatcctggatacatctatgatcagatgcattttctacgggttgtctaaaactccacgttatctacttttttgttttgttgcttgtgctttggtgttgaatgcagacacacacaaaagcctttgcctaagggaaggtcacaacgtaagacttacggaagagaaatgtaagatttagtcttatatttccttataagagttttatcactgtagctcttatatttaggtctctgatctgctttgagttaatttttgtatgtagtgtgaggtaaggtccaatccattcttttgcgtctggcggtccctcgtcattttgtgaaattactttctttctttatttttcaattgacaagtaaacattgtatatatttatggtgtacctcaggatgcttgatatctgtatatgttgtggaatggccaaatcaaactaattaacatattccacccttcacatatttatcagttttttgtttgtttgtttgttttttgtgggtagaaacacctaaaagctactgtcttacgaattttcaaataaccaatctattgctattgagtataaccactatgacttacaatagctcccttgaacttattccccctgtctaacagaaattttctatccattgccaacactccctatgccccccaacccttaacctccagtagccaccatttgtactctctgcttctatgagttccaattttgagactccacatataagtgagatcacttgctatttgtctctctgtgcctggcttatttcacttgacctcacatgctccaggttcattcatgttgccacaaatggcaggatttctttcctttttaaggaggactcatgttcctaccacgtaccccacaactcggggagacaacgtggctccgcctgagttcctcctcccgccagtaggctgagacaggcgtgcggctcgacatgtctctttcttctgtcttgcagatagctctcttccattgcattaggtccaatatcttggaaaccattgtcatctcggttatttcgttgctttgcgggggaaggatcaatgtggtgtttttttcctccaatgtagccagaaatgcaatctcctgaaacatagtttttaatatcccatacttagcaagatcttattcaggttggcagaaagaaaatgggaaagagaatgttcgtcaaagtgtctctaggcaagattttccagtgtgcaagaagatatactcaggcaagacggtttttccggtggacacccttgtgcctgcatgtgatactggaaatacttattttagagatgcgagtcctaaacaactatctctgggatgccgggagcaaactccctgggtcttctagaggcaggaatttgccaccttgtgatgatgagagtttatctcagagaccatgcggctataatttggttttccccagctggtatctgcagctccccccggctgttaacaatttctccaatgtccactcctgggtccgaagtcactgttgcttacatcttttacatcctgacccatgagaacagccttcgctcacttcaagtctactatttaagtgagagacagtgatggcatcaaccccaccaaccgcacacctcacattgggaagagcatgcagactgtgatagtggctcagagtcaagtctcaggaattgtggtggagtcacagaaactgtggtgccattcccagaaaaaccttgatcctggtcataatagaggaggggaaaggtattagggtaactcattgaggcacttactgcggagtcccaggcaaaagcgatagggtctaggtccctttggtccaaatatcggggtataatgacataagttatattaggaacagtggatgacatttcttgacaatttgacgcatcagggcatggagctctatattctccttccagcacttcacttaaaatgctcagcaaattaagatatatgtaattctgtcgccgttgtacagatgaggaaaccaaggcccagaacggtgtactgacttgtctgacagagggtgccctatcgctgtgctcctgcaggaccctgtactttgctgacccgtgcccccgtcacacagttttgaatggaaaaggctatctctgttcctcacgccatacattgggagacgacagtgtctagggaaagttggaacttaataaggaactggaaggcctatgttcttccctcctcctactttttttgtagctgaattgctttacgctcagtttttacatcaaagaaatgtggatgacggctcctgagatagtggtcctggaagtactgcctacacctcaggctgtgtgcagttaagacaaaagctgcatttggatttttgctcaaacaacaagaagacgaataaaaagggctcatatgcagtaagtgcttatataggctaggctccatcattccttcatgggcatgctctcactgaagcctcacagagaaggtgaatgcaacttttaaaacttgttgccatttcaggcaggaacaagtagcagagttgggacacaagcccaggtggatatccgttcaaagcctctgtcctcaaaataagtgttttccaaactgtgatatgcaggttgtttgtggccatagacacaagtatattggcacatgaagaaacaacgtgggggctcatgaaatagcagaacatccaatctacggtcatttcagatttttataggaggcccgcgtcatggtggcgtgcactgggcagctggccacaggatctcggccagggatgaagagctgcttttgatgtgaggaggagatagggtgaaatgcgtagagagttggatccatgaaaacagagaggggccaggatgaatggggcagaagtgcctgagagctacttttttccccagtccttactgaccatggtatccaatcaccctggctttccaacttcttcctgccacctgccctcttggcatccatgggcttggtccttccattatcagcgtctcagtttctttctccaccaattgagattaacaataggtgttctgaaagactttagtgagaagtaaataaaggaacacacgtgaagtatttgtgagagagagagagtccttaggtctatttcatatttttcattttcaaaggcacatgtacaaattatgtatcacacctgtaatctcagcactctgggaggccgaggcagtcgggaagcttgagctaaggagttcgagaccagcctggttcacatggcgaaaccccgtctctacaaataatacaagagattagcgggctgtggtggcacgtgcctgtaatcccagctacttgggaggctgaggtgaaaggatcacttgagcaggggaggtgggggctgtagtgagccgagatcgagccactgcactccagcctgggcaccagagcgaatatctgtctcaaaaaataaaacaaaataatagaaattatgtataataataaacattttcattacatctatttctagttatattttatgaccagtgatcttgtcttccatttggtttcatgctgggaattttcctttttaaacacatttctaagtctttccttgacgcttgtcagaaaggaaattcaccttctagtctggagttcatcctaagatgtcatctgaagagccagcatacaaacaagcggcctttgtggatcggtgccagatgcgctcttccattctactgagaggggggtgtttccattcccttccctatggtattctatggaagagctgagctacattctaagaacctcgcttgagcatctttacccaactccactttttgtccatagccttaagtccttctcacattctgtttgacacattccaaacccactgtaaatgcttgtggaatggatgaacaagtgaacaacgggcttaaaaaggagaggggaagggacagtcagtggcgtggggctgaggcagtccagcatatgcaactagcaggaagttaaagatttctggggggggtcagaaataccgatggtcccgaagttaataagacttctaccctgggctgtgtttgcgtgggcatggccaaggtcggctccaggactaaccagccagcccccttctgactgtcgtcttccctccgtacctccagtcattcatttagtctgctcttggtcttgctcagagataggagtcagtcacctattttgtttccttattatgtcttcaatcatacacagctgtacacaaaaaaatatgtgacccgttaaacacatctgagtggccaccatgtgggagaaccgaatgaaacataaccagctccctaggagcccactgtgccagactgtatggccacaaaaatatctcccatctctcgtgctgtgataaaagttgccccgttcacaccgagacctgcgatttaatctccctcccacgcttgaatctgaaaaggctgtgactcacctctaatcaatagagtatgacacagttgactcaacatgacttctgagtcttgcctatgagaggtgatgcaacattcaccttggatatggaaaagtgccgcttggagcctgagtcatgaggtcggaagcctgactactgggaggcccaccctgctgtgaggaagccaaaggccacggagtggtaatacggaggccctccactcgccaggcctagtcttccagtcctctccatgcaggcaccagggatgtcagtgaatgagccttcagatggttccagtccccagccagtcaggtttctgcagctgaggtcccagactcatgtgaagcaagccatatccactgtgccctttctgaattcctgcctctgaaattccatgcatatgatacaacgctcgtcattgtatggactcactgtggggctgtttgttacacagcaagaggaacaggaatgcaggacaccctcccctccccccacccccactcaaagccattcctcctccatagagttaaaccctaatctgatgctggcttaaattatttcactgcctaattcatggttttcccatgtgtatggacgcccctaaacaatgcggtttcatattgtctgggtgccttgataggaggagttttgggggcctgaaattgagaaaacaagcattcatggatcaggtagtcaaggcaaggcactgtgtttaccccaagaacaaacactctgttagctgttaacattcttgaggaaagagcaagttgaggaatggggtttaatctactcgataccggttatacagcgagcaggcggcaggtccaggattcaaacacaggtagtgtgtccccagaggccaaatgtgtaaaccctctgctaattcccctcatcaaaaggtaggggaccctggggaagctttctctactacaaaagccagagtcaccaccaccttctgaaataatctgagaccaagtaccttcaaaaaccaagccttgccatacatagccaagccggactttatagacacaccaacacacatagtttcctagaaggtatttactgatttctatatacttaacacatgtacaagacaggtatttcaaaagattaaagagggcagacagtgcgcagatgtctttctcattcctgtgtgcacagatgtctttctcattcctgtatccccatctccttacccagagacacttcccaaacaacaagcgaaatagtaacagctttcgctgttacaggaaataaagagtaatgaggtatgtaacacgaccaaatcttgaaatatatcatttaaaaaccagtaaatagcataactcgaatctaagcagtgaaaatatgaacgtctacctgaaactcacaggtgcgggagcccacgcacaccataatcaatggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccgcagcttcctgaacgtctcccagcgctcccgctgtgcgcccaggtccagatccttgggggacggggcgggccccggcgggtacggggttggcgcggagggcagcaggtctctggggcccgccttccggacccgccgccagcggcgcttccgtcgccacctacccagccacctcttggccgccgcgtggctcccgaccccgacttggacccgggggcactgcgcgcggctggcgcccgtgaccgcgatggccgcgcaggcggcgggaggatccccgggccgctttcgcctccgccgctgagcagtggcgcggttcctcactctgcccatggcgcctgcagcctccggagcgcgtgcccacaccccaccctcatttccccgtcagtcgctgagcagcctccttgcctgcgccagcaggattggccccttgttgaatgcgatgtaaagagacccttcccttgaccctatcacaacagccttcgctggcctgaaaggcagtcatgaggcgttcagcaaacacctgccgggcaccagataccctcacctgggcgctgggatgtggagatgcatcaggctttccaaagcactcacattcatttaggatcaggtgtatgcaaatacagtccccaacaccttgggacactttgctctgacagaaataagaaccaggggctctgggaacagagaggaacgcccacacactgtaattggaggggcgtgtgggaggggcacggaaagactcttctaaagtcttcttgggggcttgattcttttattcggctgtagcgttttatttttcttgtaattttcgttgcgatgaagtcctctttacctaatgttgacatacctacttctgctgttttaattaatgtttacctgatgtgacttttcccacccgttgtatccttttcatttacccagggcgaccgaagtggaactgagtttcatataaacatgggataatcagaccgtgtttctcactgactctgccagtatctaccttttcatacatgtttctagttcatttccatgatctctgggctagtgtttaggtccacagatttattgtttgttttcttttgtttcctccgtgtctcggctaaccgagacctcctttttttgcccttctgtggcttacgtgtacaccttgcaggatttatcctgatttccgaaagtgttttcgagtgtttggctttgtaaaattgtctcagtggttgctctgggattttcagtgtgcatatgtgacttaccacaggctcctggtatccagttctcatcacttccattgaagtgtagaagcatcagccccttttagcccctctgccttcctgcttgtagacaacgttgtctggagtatcggatggtttcatagtttttgctttaatcgtcaaacatgacttccacaattcacaaggaaaacggtggcttagtgtttgtcccctaagggtgttttttctactggtcttgactcctttctgatagatacttccagaggccatcttttattctttcctcttttgtttcaagcacctactctagccattctttcaccgtgggtctgctcgtgacaaaatgctttcctttacctgagaatgtcttgatttccccttcgtccatgaaggatggtatcactggatacaaaattcacagctgacaggacttttgttcaacatctgaaacttttcgggacacttcctgatgaccgccactggtcagaggagacatttgccctcattaaaactggtgttctcctataatcaatgaaccacttcggtcttgctgctttcagtgattttatcagcttcaaaaactgactatgatgtgtgtgttggtgtgaatcgctttgtggttgtcttatctgaagtttgctcgttttccagaatctatgggtttatggttttcactaaaatttggatattttcagccttcttttcttatactcctctttcagtccactctctacttttggtactccagtcgtagggatattggaactttgttattgtcctaacttcgctgaggatccattcagcttttaatcagtccacgatctctctctctcgctcaggcacagtcagtcctattttctgtttgtttgttttgtttcttgaggaagagtctcgctctgtcacctaggttggagtgcaatggcgcaatctccgttcactgcaacctctgcctcccgggttcaaacgattctcctgcctcagcctcccaagtagctgggattacaggcgcccaccaccacgccaagctaatttttgtatttttagtagagacagggtttccccacgttggcccgcggtgatctgcccgccttggcctcccaaagtgctgggattacaggtgtaagccaccatgcccggccgtcaatcttattgattgggcctccattacgatgatggtatcttttgtcatcacaggtctcttaccgagtgcatccagcaatgtttccaaattctgttattgttttcgttttctgttccatcatttcttttttatacatcttctactcattgctgagattttccattttctagtctggttccagactatttgcaattacataatgaagcatttttatgatggttgctgtaaaatgtttgtcagataatggcaacatctgcgtcgtctctatgttggtaccactggattctatttcctcattcaagctgtgttattcctggttcttcacatggtgggctatgctctatggcatacaatgtattttgcttgttactttaggagtctctggacaggagacaaatatttgatgttagaagtcagctactttctttaggtttagcatgtagattctggtgtccatttttaggttctgggatttttaaaaagtttattttcagagcatttgcggtgctatttttgtgtgtttggcttacctgccgacacagcagccccaactgctccctactggtggtatttgagaggcagaaaaaaactaaagtccacactttattccaggtttcctacttacttcctacctaatatcattttttttttctgttcccagataccatgcagcctaccacactacatttaatcatcatactgccttaggttcctcttggctgggacaacttctcagactttgcttgtttccatgaccttgagagttttcagggtcactagtgaggtattttctagaatatctttttttttttctttttctttttcttttttttttttttttttttttgagacagggttccttgcttcccaaagtacatgggactacaggcatgcgccactatgcccggctaatttgtgacttgtgtgtgtgtgtgtgtgtgtgtgtgtgtgtgtgtgtgtgtgtgtgtgttttgtagagacaaggttttgccatgttgcccaggctggtcttgaactcctggactcaagtgatctgcctgcaccggcctccctagaatatttttcaactcaagtttttctaatgcttgtctcatgattagactgatgttgtgagctaccggagaatcaccacaaaggtaaagagctgttttcgtctgatcgcatcaagggtacataatatcaacatcagttttgattgtgtaagttgaccttggtcacctggcagaagcagtgttggacagggtgctcccatgaaaagttgctcttttaacccctgtccacatgctactctttggaaggaagtcattaagcgaagttcacacctaactggtgctaagttttaaatcctttctttgaggcagagtatctacatacattctttggaattctccttcatggcacagctatctatgctcctgcatttatttccttattcaatcgtttatgtatatcatgatactttcacggatatttacttgatactttagattataatccaatactttgctatttctttttcattattatcattcttgcagttgtggccactgggtgcacgttcagttcacccctaggtcccgttggtatgctcccattatttggggctccattttgtgtaattccttgctttgtggctcatcctgcacatttctgtcttgcatatgttctaggctggtctggcctatttactagctcctaggatcagccaattctccaaggatttctgtttccttttattagaaaatggtatcagagaccaacgtctggcaactaggtgtgctcgtagctgccagagtctagtggttcctaggccctctctgctgaagcagaaaggaaatacgtatgtatgtatactaacccacgtatgtacacatttctataaatattttgatacatgaccatgaggatctataataagctgaatatgagttcctacccatgtctgcaactctattccattgcagcacgaatcattcttgcccctgccacattacgatctgcacctccctctccagcagtgaaaaacctgcctctcaccctccaccatccatttactcattgcagttccagtacacatggagaacggtgtcagatttttcaacctgtgtccataccggcaacaggtttgtctagtcgagtatgctgcatatgtacaattgcctttgtctttagccttacacacttctttcatttccaaagttgcttagatcagcactttgtacttcacagccttcagtgaagcttttcattcattggtaaggttagaaccttttgtcacattctgcatttcaacctgatagttccctacctccctaatgatgtcttaaaagattaaacacgttaagtttcattctgtgtcctgtcagtttccacggattctgacaaatgctttgtctcatacaaccatcattagggtatctcaccctgtcctcacacagagacagctatttttatttcctcttcttcggaggacacgaaccctatcataaagactccaccctcatgacctcataacctcaaaccccattacctcccagaggcctcacttgcaaataccatcacactgggagtcgggacttcaacacgtgaatttgggcgggaagcaaacattctgtctataacgcacatgatggtttcactgccctaaagcattacctgtgctttacctactcatgtcctcctgtaaaagtcccctccacatagcttgcctccttctactcatccttttgaataaagtttctctttactaatcctggatttgtattttgtttgacaacacgtacgttttgaagcaaactgggcaaacacttaatagcgagaatgctggaccaccagtgtggcaagactattgagccttgttaaggaccaagcagactctcttccaaatttgctggaagatagagacttcccactttacatgaatggacgttcctgttctgcatccttggcagcagttggtttgtcagtttgggggtcttggccgttctgttagatgtgtagtgtcatgtaattattatttgagtttgcatttatctatcaatgccaaataacagtaaacattctttcacatgctcatttatcacttccaaatctttggtgaggtgtctgctcagacctttagctcatttttaaattgggttatttgtggttgtttggtttttgaatgtccacagttttttgaatatttggaatcaagtcttttctcagatatctctttgaaaatattttctttcagtccttaggttatctttcttccttaacagtaatgtcttccacacagcagaagttttaagttttaacaaactccaaataattgctttttgttcacagactctgtggtagggtttgtgactaaaaccccatcaggaaacacaaagacatgttgatgtttttcctgtgttttcttccctgtgttttatatttctatatttctttttttattttatatatattgtttgtttgcttgttttgttttgttttgagacagagtctcgtcctatcgtccaggctggagtgcagtggcgcgatctcggctcactgcaacctctgactcccaggttcaagcgattctcctgcctcagcctcccgagaagctgggattacaggcgtctgccaccatgcccggctaatttctttttgtagttttagtagagacggggtttcactatgttggccaggttgttctcgaatgattgacctcgtgatccacctgcctcagcctcccaaagtgctgggattacaggcgtgagccaccgcgcctggcctataatttatatttttatatttcatgtgctttataatttgaattttacatacgggactttggtcctttttgagttaatttttgttaaagtgtaagttcttggtctaggttaatgttttttccatatgggcccgaaatctcccaccaccatttactgaaaaggctatccttttcccattgtattgtgcacgtgcctttgtcaaggatcagttgagaaatatttctgcagttcgattattgggcttgctagtctgttgcattgaactgtgtgtgtattcttagtaaatgccaccctgtcttgattactgtagttttatagtaggtcttagaatcgcatcttatgacttttgcaactccattctcctttttttagaatggcttttctattctagcacatttgtgcttcagtacgaaatttcgagtcaatatgttgatatctacaaagtgaatgctgtaattttgattgggattctgatgttacaatagatcagtctcagaggatttgaaatcttctaacaattacaaatcttccagtccgtatatatgacatctctctccacttattcagatcttctttgttttttctttcctcatcaatatttgtagtctctgcaagcagatcctatgcctgacatttagatttagacctaagtacttaataggtacttaagttgccctttaaaaaaatcaaattctcattgttcactagtcatatacagctaaacagtcatcatcaatatatcgattgtgtcctgtgaccttgagaacctcatttattaattcagcagtttgttgcaattctttggagttttctacatagataaccatatcccctgtaagcaaaaagtccctctttctttatgttgttgtctcttcaggttttacctgggcattggtagcctctcttagcatatggatcatatggcttttagaactgctttttgccctaggctttacaatatacatatttacctatcccagtccaccgtccagtaacagtacatcacttaatgtgcagtgcagctacctaacccgacagaattcccaattaacccctcatgaacttatccgtatgctatatagtcaccaaatacattgtcagtattattttaaacaaaccgtgttcctttagaccttgcaagaataagcaacagaaaaggtgcgattttacctccacttgttccttcactgattctggccctgcctttatgtagattcaagtgtctcatctatcttattttccttctgccttttaacatttctcccagagcagagtttctgaaggttaatttgcttgattttaatttgtctgagaaagtctttgtttcctgttcacttgctaatgataattttgcaggacatacaattctagctaggtgatatttttcttcactcaacactttagtatttcagtctacgctcttcttttttcgtgggttctgacgagaagttggccataattttcttccatgttcctctaccagtaaggtgtttttattgaggttttcagactttctcttcctctttagttttctgcagtttcactatgtctagacgtgagtttgtgttgtgtgtgtgtgtgtgtgtgtgtgtgtgtgtgtgtgtatttggtatatatgctgcttgatatatgctgagagattcctgactctgtgctttggtgtctgttattaattttgacagcgctaggcccttattgcttccaacgtttattctgctctgttctctctgtcttctttctctgtctgggattcagattaataggtcgaaccttttgcaattttcacacagtaagatgttcaattccatttcttcccctctttttcctctttgcattccgttttggaaagtgtctgttgtcctctgacctttcagcatgctttccaattcttacctttgttgtgctgactctactgatgagcttctggaagacattcgtcatttctgttagtgtttttgatttctagtatttccttttaattctttctgagaattcccatctctctctccctttgtcctcccacttgaatctgaggctaacagagtgctcctgctcagggagagcctgtgtcttgcagcacgttcagttgtaacccgccgttatttccctggagcctggttgtagtggtggtaaggtgtaggggcaggaaagcattccacagctttatgactggatctctgcctttcaatgggactgtgtctctgggctgtgaccttgacaagtgtttctccagtggtattaccctctccccatgtccgtggtcctttccctggcttcagcattcccaaataatacctttacacacttgagccctcttgatttgtttttcccccacaggtgacactggaagcctggaggggcagacgatggaggaatacccttcctgcacctaagataaggctttggtcaagtcttttgctctgaagactgggcctttgtcttggagaaggcactgggagtatttgacaacgattactcttcctctctcccagccagaaaaaccacggcgtctttttcagatcttcaccatgaaaacccatgtgttgagccaaaggccatgaacatgtggatgcccctgagactgcgggcccccagcgtattctcacactaatgccagtccacacacagcctcaagcacttcatcgtatttactactgaagcactcctacaggcttctgtctgcagaagctgctgattcaggtaagcagatctcagctgtgacactggatttgacagtctctcaagattccagggtggtgtcttgctgtcccctcttggttctctgatgagtccaaaagatacctgaatccattttccagcattttcttgttgtaaggatgggattggtcatttgtctatttacacatagagctgaaagtggaagtctcatttgtggccatttttgaaacatgtcacaatcagaataagtctatggcttgcaaatatcttgccaagtcctaggagaagccgatgacagttgaaagtagttgtcgcagggagccagcaggagaagtaggtgtgtgtggtgggggtgggaggttttcagaaccaaatgacttctgttctcattgaatgcaaattactattacattgtttagtaatgtaattactaaaaggtatgactgtttaactcttaaaatcctatatatatataatatatatattatattatatattatatattatatatattatatataatatatattatatattatatatattatatataatatatattatataatatattatatattatatattatatatattatataatatattatatattatatattatatattatatattaaatatattatatattatatataatttatatattatatattatatattatatatattatatattatatattaaatatatataatatattatatattatatatattatatattatatataatatattatatatatatacgatttgagaaaattaaataatggacagtgcattttatgtagaaattgtctagaaattttgcatgaaggaatgcacagaaattgtaaacataatttgaaggttaaataaatgccctcaaatgcatacaatttctaaaactgttattacctcttgcttgctggttgatgtcagctgtcagtattacctcctcactaggcatgcattgcctaggatcacagcagctttacacaccaattggccagggcgatgatgttaaaatcggcctctgccaaatcatgaggaggcaatgacgtagaaggggaccttatccccatttcacaaatggagaaaccaaggctaaaagagactaagtaacttgctgaaagtcatacactatgtaagtggtggatctgggacagtctcccaagctgtgtctgacatcagcacccatgtcctttctggtatacttctctgcctatccaagggtgggcagcattttgaattgtcacacctttttcggataatggtgttctttttttgttttcttttcatctgagcttggaaaaaaagtactcacaaatacacaagtagagatgaatacaatcatctgatactttttagaaaataaaaacccataagcctcattaaattgacttagaagctggaaacaaagataaaaatcttccaaatttatttactgaaagtagcctgataccaaaatctggaaaagacagtacatgcacaagggaccccaggtgcgcacgggcacacaggcacgcacacacacacacacacacacacacacaaacacacacactcacaggcatgcacacgcagagagaaatatggatctatatcacttatgaaatctatcactaataaatttcattttgtgcccctaaagtttcagtggataaatagcaatgatatgtagaaaacctaccacacatctggtaggttttttactcatgagaagatgatgtcatatttagaaatatatatgtacaacatggtgactactgtgaatagcaatgcattgcatacttgaaatttgctaagagagtagatctccagtgttcacaccatacacaaaagggtaactgtgtgagatgatggatatgttaattagcttgatcttggtaatcatttcacagtgtatacacatatcgaaacatcacattgtacttcctaaatatacgcagttttatttttcagtcatacctcagtaaacctgggagaaatctcatttgctgtagaggaacacttctcatccaggggcattttgcctcccagggaacatctggcaatgtttggagacatttttgtttatcgttactggggaaaagaggaggtgcttctggcatccagtggatccaggctagtgatgctacttaactccctgaaagcacaagacggccacgcgctataattatctcgtccaaaatgtcaatagcatcaacgttgacaagctctgtcgtagggtatttacataactcagaaaagccagaaacaaaatttaactcatgtgcagtcctgccagtgatccataacaattgctaaacatttgatatgtgtgtgtgttaaattttctgctacagttttttacctcataatcaccaaaagactatggttggaggaaactattttatttcaaaggttaattcttccaccacattctacaagtgtttttcaaatattccacatattagtctgtgcttaagaacacatgtcccttaagatttgtaatttcagctgacttacatggaggggtattctactagtatcaatccaccatcacctgtctcctgattttcacctttctgaacagaggtatcatttccatatatttggtgaaaataaagaaaagcagtgcctcataccacaatgcatgtgatatacaaagggctgcgtgtttgactaactgcatcaaagcaatcccattaccccaccagtgactggctttgaaatgggcctttcccagttgccatccatgagatatgggtgtttgttggcttacagtcttcgaagaatattttctcagctcttagagatatagaagagacacaaaagatggtacacacgcacgcacacacatatggttgcacacacacagtctaaaagaatatctaggattataattaacaaatgaatttagtgtgatattgctgggtataaggtcaatatcacaaaattcaattgaatttgtatatcctggcattaaacatgtaaagagacaacttttaaatgtcatttctcatagtatcagaacacatcaaatgcctaggaacaaatctagcaaagattcccaagacctctgcccggaagtctacacaacattttcgagagaaattaaagaagacctaggtaaatcagagctatatcgcacttatggactggaagacaatgtcatgaaagtaaaccgaagagagaattctaatgaaaatgatttatagattcaatgtgaccccagtgaaattcccggctctttttctgaaaagggaaataaatgggcacgccacttctaagttctataaggatgtccaagatccaagaaaagccaaggccttctaaagcaagaacactttttagaaccctcacagccagatagcaataccaaccataaaggtatcataattaaggaagtgtggtacgtgcacagtaatagacaaatagaccaatagagcaaagagagggtcccacaaacacaggtgcacatacatacgtatatggtcacgctcatttacaaaaaatgtgccacctcaatgctctggaggcaagatggtctattaaataagtggagctggactaatttggatatccatatggaaaaagattaacattggcccctaagttacaccatacacaaagattaactccagaggttatggcttgtacaaaataatgcataagcatatctgcatgaccttgggggtgagcaaagatatctgaaataggacacagagtcactaacgataaaggaaaacattgttcatctttacgttatcaaaaggaaggacctctgttcatcaaaagatgaatttagagaatcaaaagataaatctcatgatagaagaaagatatttgcaatatacatatgtatataccacaaatgtctgatgtacagaatgtaataccccctaaaatcaagaggggaaaagaataatgcaacaaaacattggcaaaatatttgaacagcaccttcacaaaacaggacatccagcggactaatagacaaacagacaaacagctgctcaacctcagtcaccagggagaagtcagctaaagtcccaatgagatctccccaaacacctgacagaagagccaacacaagcaacaacatgaagccttggtgaggatgtggaagagccctctacggccggcaagagtgtaaacaggtacttgcactttggaaaactgtttggccatagctatgaaagctgaacatgtgcattttctataagccagcaattctgtctgtgttagttgcctattcctgcaaaacaagctgccaagccttagtggcttgaaaacagtgtgtatcttccagcttacagttctgtaggtcagaggctttgttctctgctccatgtatcacagggtgaaatcaagctcagccaggcagtgtttctctgcggaggctctgaggaggaatccgattcccagctcattcaggttatgggcagaattcagtcacgctctcagctcctaggcaccgcctgcagttccttgccatgtagaccaccccgtacaccctctcacacttgaatgtctcaggaagagcccaggccattttaagagctcacctgattaggtctggcccacccaggataacctccttatgggaaagtctcctgatcgggaccgtgatacatctgcaacatctatttccacaaataatgtgacgtaatcacaggagggatatctcatcatattcacaggctcttctcacactcagagtgagggggttatacaaggccaaggttagttagggtcaaccttggaattctccccaccacagtttgccctctggcccccagggatccatctgtctcacatacaagatactttcaccccatcccagatttctcatgatattccagcatcacctcaattcctgaagttcatctaaatcttatcagttcaaagtcttgactctcctcatctccaccatctaaatcaggcacggatgatgttcctgggtgtgatccactcagtacaactccgggaacagagtccctctccaactttgggtcggtgacactaaagtgacaagctatcttcctctaacactcccaaaatacagtgatgggagaggcatagggtaacagctgtaaacattctggtttgatgcctggggaggggaagaggaaaggtaggaaggtgttagcattctaaagcagactggaaatccaactgggaaaacaccagaattctctgataaagtttcaaagcctggaacatcctcggcacctctcggtcctgcctgtgggcccttggttcttcctcctgggtcatgtttccttcttcatgaatggtagcaggtgtgtgcagctgagtagtcgtatcagcctgctccctgcccttagcatcttaggggtcccacagcccgtctctcttttcctttgaggccagtgggtctggcatccagtggatccaggatagggatgagacttaaccccctgaaagaacaagacagcctcccacaagaattatctgaccccaaatgtcaatagtcaataatgcagatggtccaggctgacagtatttctgctacctgaagtttctcaagaaccttgtgtgattcatgtggattttactggcattcactgtattacacacaagccgcgtcgcccatttgttcaagatactgccttcttcatttgcggttattgcggagatgatggagagacagcacccttaagcttcccagaggcctgctgatatagttgagacaatctctgaggcacatctttagcttcctgaaaggggttttttgtgggactgaatactctggactgttggccttactgagctctcagcaaacgttgaaccttgaacagccacactctctgagttctccctaggccacacactcagaagcattctcttcatttagcgcccccaaccccacccccacagggattcctctagcatggctcagtccaagtcccaaagcctctgaaccagggaagccgatgtcgtaattctcagtccagagctgaaggtctgaaaacccactgggccactggaataagtcctgaagtcccgcccctccccccccccaacatctacatagcctgaaaatttcccaaatcatcccatccctgttccttttgtttaacatctcttcccacaatttctctttcacctttcactttctatattggcatcaagaagtaagcaggccactccttccgcaatttgcttggaagggtcctcagcaatataataaatataacttcataattttaaagttcagctttccccctttccccattaccgtggaatacaatcctgccaagctctctgccactctctagtgacattcccccttcccatagtttccagcaacatgctcctcactccttctgcagcccttacagtcggaaactttcaagttcacatttgtactagaagtctgtacaccgtgattttggccttctcagaggcaatgtagggtctcccgaaagtcctccttattgttggagagctcccagcagcagatattttaaattccagatttgtactgactgtctgctcaaggcaaccttggtttctctcttaggctccccaaatcctgccaacctccacccactgcctcggccatatatccaagtttgtcgtttatatttttcttctttccacaaaactgtgggcaataatcttgttaaactttcggccactacctagcagggatctccctttctccagtttacaatgacgcgttccttcctccttctgaaccctcatcagcagtgtcctgaaaagtcagacttctactaactgtctgtccatggcaatgaaacctttcccaaggcgatttaggcattctatcttgtgcacttaagaattcttccagccttcgccaactacccagttccaaagccacagtcacacttttaggtgtttgcagtgtgtgatggttaattttacgtgtcaacctgactggaccaaggaatacctagagaactggtaaggcattacttctggctgtgtctgtgagggtattttcagaggagattgtcatgtgagtcagtggactgagtggccaacattcgcccttgacaaaggcaggcatcatccagtcagccaggggcctggagagaacaaaaaaaggaaaagaaaggatttcttcccttccccttccccttctccttccccttccccatccttttccctttctccttccccttccccttcccctctctctctctctctgtctcacagagctaagacactctccctctcctgatcttgaacatcacgacttcagactctctggcactgggactccaggacttacaccagtggcccaatgggttctcaagccttcagcttcggcctgagaattaaaacaccagcttccctgcttttgaggctgcgggacttggactgagccagcctccatcatcacgtgagtcaatccccctaataaatcacctcttgtacatttatatctatcctattggttctgtgtctttggagaaccctgaataatacacagtgtagcaccgcacattcaggtaccaaaacctatactggttttctgttggtgcagaacacattactgcactcttagcagcttaaaccaacactcattagctcacagtcacgtaggtcagaagtctgtgcattgcgtcactggcctctcagctcagggtctcacagggtgggatgctgttagacttgctgtgttcttttctggagtatctggggacgatgcccttgctgacccatccatgttgcagctgaattcagtgccctgcagctagaggactgaggtccccttctcttgctggctgtcagcggggggacagcactcatctcctagaggacacctgcagttccttgtcatgtgccccctccaaacgctttctctgcttcaaatctctcagcaaaaacctagacccttgtaaatgcacatccgattaggtctggcccaccccacataatctccttatcttaaagggcaactgattgtgaccctcattccatctgcaaaatcttcttgccctaaaagtaatataagtctactaaaagcaggcaccctgtagtcccagctactcgggaggctgaggtaggagaatggcgtgagcctgggaggcttagcttgcagtgagctgagatcgtgccactgcactccagcctgggcgacagagcgagactccgcctcaaaaaaaaaagtaatataagcatgggagtaatatcctgtcatatgcacagtttccaccccaactcaatggaaggggactcgaaaattcaagggtcaatgggagtcatcatagaatgctgactaccacacaatccaagaatatatgcaacagaaatgcataagcatcttctccataagtcatgaatgaagacattctcagcatcatcactgatgtgagtcagaaccagaaaacaatctgaaggactcatcacagttgaatcgatcaatagattgtggtatattcatacaacagaccattatacaacaataacacaagcaaacatctctacatgcaccagcatgggtagacctcaaaataagagtattaagcagcaaaacaagccaggcataaaaatgtccatgatttataattctgtttgtgtagggttttaaaacagacaaaaaaataaccacactgacagagatcagaaacctggatactttcaggggtgatgactagatagggacataatacaggtttctggggtgccaccaatgttctatatactactacacatctaaaatcccgaatgttgtgtaaaccaattatttttcctgactcgtttgtccataaaacatgacctgagctgatatgatgttgtttgtagtcttttggggtcttatctttctgggtaaaaatatttacatttctcagtggaaatattgttttatcgggttcagctcactagtccagaccctgccatggttcttatgtaaagtatggtttatgaattctaaaacatttggtcccaagactttcaggtaagggattgtggataggtggtattagaggattttaacataattctgccaacccaacacagatttagtagacaagagctaagaaagactgaacagagcttatcgaagacagattgaattttagcctgtttttttcttttttttccagcaacatttcagatgatatgttttttctccttggacctatcaatataatggactaacaatatatttctaaatatgacatcatcttctcatgagtaaaaaacctaccagatgtgtggtaggttttctacatatcattgctatttatccactgaaactttaggggcacaaaatgaaatttattagtgatagatttcataagtgatatagatccatatttctctctgcgtgtgcatgcctgtgagtgtgtgtgtttgtgtgtgtgtgtgtgtgtgtgtgtgtgtgcgcgcgtgcctgtgtgcccgtgcgcacctggggtcccttgtgcatgtactgtcttttccagattttggtatcaggctactttcagtaaataaatttggaagatttttatctttgtttccagcttctaagtcaatttaatgaggcttatgggtttttattttctaaaaagtatcagatgattgtattcatctctacttgtgtatttgtgagtactttttttccaagctcagatgaaaagaaaacaaaaaaagaacaccattatccgaaaaaggtgtgacaattcaaaatgctgcccacccttggataggcagagaagtataccagaaaggacatgggtgctgatgtcagacacagcttgggagactgtcccagatccaccacttacatagtgtatgactttcagcaagttacttagtctcttttagccttggtttctccatttgtgaaatggggataaggtccccttctacgtcattgcctcctcatgatttggcagaggccgattttaacatcatcgccctggccaattggtgtgtaaagctgctgtgatcctaggcaatgcatgcctagtgaggaggtaatactgacagctgacatcaaccagcaagcaagaggtaataacagttttagaaattgtatgcatttgagggcatttatttaaccttcaaattatgtttacaatttctgtgcattccttcatgcaaaatttctagacaatttctacataaaatgcactgtccattatttaattttctcaaatcgtatatatataaaatatattatatataatatataatatataatatataatatattatatataatatataatatatatttaatatataatatatataatatataatatataatatataaattatatataatatataatatatttaatatataatatataatatataatatataatatataatatataatatatataatatattatataatatatattatatataatatatataatatataatatataatataatatatatattatatatatataggattttaagagttaaacagtcataccttttagtaattacattactaaacaatgtaatagtaatttgcattcaatgagaacagaagtcatttggttctgaaaacctcccacccccaccacacacacctacttctcctgctggctccctgcgacaactactttcaactgtcatcggcttctcctaggacttggcaagatatttgcaagccatagacttattctgattgtgacatgtttcaaaaatggccacaaatgagacttccactttcagctctatgtgtaaatagacaaatgaccaatcccatccttacaacaagaaaatgctggaaaatggattcaggtatcttttggactcatcagagaaccaagaggggacagcaagacaccaccctggaatcttgagagactgtcaaatccagtgtcacagctgagatctgcttacctgaatcagcagcttctgcagacagaagcctgtaggagtgcttcagtagtaaatacgatgaagtgcttgaggctgtgtgtggactggcattagtgtgagaatacgctgggggcccgcagtctcaggggcatccacatgttcatggcctttggctcaacacatgggttttcatggtgaagatctgaaaaagatgccgtggtttttctggctgggagagaggaagagtaatcgttgtcaaatactcccagtgccttctccaagacaaaggcccagtcttcagagcaaaagacttgaccaaagccttatcttaggtgcaggaagggtattcctccatcgtctgcccctccaggcttccagtgtcacctgtgggggaaaaacaaatcaagagggctcaagtgggtaaaggtattatttgggaatgctgaagccagggaaaggaccacggacatggggagagggtaataccactggagaaacacttgtcaaggtcacagcccagagacacagtcccattgaaaggcagagatccagtcataaagctgtggaatgctttcctgcccctacaccttaccaccactacaaccaggctccagggaaataacggcgggttacaactgaacgtgctgcaagacacaggctctccctgagcaggagcactctgttagcctcagattcaagtgggaggacaaagggagagagagatgggaattctcagaaagaattaaaaggaaatactagaaatcaaaaacactaacagaaatgacgaatgtcttccagaagctcatcagtagagtcagcacaacaaaggtaagaattggaaagcatgctgaaaggtcagaggacaacagacactttccaaaacggaatgcaaagaggaaaaagaacatcttactgtgtgaaaattgcaaaaggttcgacctattaatctgaatcccagacagagaaagaagacagagagaacagagcagaataaacgttggaagcaataagggcctagcgctgtcaaaattaataacagacaccaaagcacagagtcaggaatctctcagcatatatcaagcagcatatataccaaatacacacacacacacacacacacacacacacacacacacacacaacacaaactcacgtctagacatagtgaaactgcagaaaactaaagaggaagagaaagtctgaaaacctcaataaaaacaccttactggtagaggaacatggaagaaaattatggccaacttctcgtcagaacccacgaaaaaagaagagcgtagactgaaatactaaagtgttgagtgaagaaaaatatcacctagctagaattgtatgtcctgcaaaattatcattagcaagtgaacaggaaacaaagactttctcagacaaattaaaatcaagcaaattaaccttcagaaactctgctctgggagaaatgttaaaaggcagaaggaaaataagatagatgagacacttgaatctacataaaggcagggccagaatcagtgaaggaacaagtggaggtaaaatcgcaccttttctgttgcttattcttgcaaggtctaaaggaacacggtttgtttaaaataatactgacaatgtatttggtgactatatagcatacggataagttcatgaggggttaattgggaattctgtcgggttaggtagctgcactgcacattaagtgatgtactgttactggacggtggactgggataggtaaatatgtacattgtaaagcctagggcaaaaagcagttctaaaagccatatgatccatatgctaagagaggctaccaatgcccaggtaaaacctgaagagacaacaacataaagaaagagggactttttgcttacaggggatatggttatctatgtagaaaactccaaagaattgcaacaaactgctgaattaataaatgaggttctcaaggtcacaggacacaatcgatatattgatgatgactgtttagctgtatatgactagtgaacaatgagaatttgatttttttaaagggcaacttaagtacctattaagtacttaggtctaaatctaaatgtcaggcataggatctgcttgcagagactacaaatattgatgaggaaagaaaaaacaaagaagatctgaataagtggagagagatgtcatatatacggactggaagatttgtaattgttagaagatttcaaatcctctgagactgatctattgtaacatcagaatcccaatcaaaattacagcattcactttgtagatatcaacatattgactcgaaatttcgtactgaagcacaaatgtgctagaatagaaaagccattctaaaaaaaggagaatggagttgcaaaagtcataagatgcgattctaagacctactataaaactacagtaatcaagacagggtggcatttactaagaatacacacacagttcaatgcaacagactagcaagcccaataatcgaactgcagaaatatttctcaactgatccttgacaaaggcacgtgcacaatacaatgggaaaaggatagccttttcagtaaatggtggtgagagatttcgggcccatatggaaaaaacattaacctagaccaagaacttacactttaacaaaaattaactcaaaaaggaccaaagtcccgtatgtaaaattcaaattataaagcacatgaaatataaaaatataaattataggccaggcgcggtggctcacgcctgtaatcccagcactttgggaggctgaggcaggtggatcacgaggtcaatcattcgagaacaacctggccaacatagtgaaaccccgtctctactaaaactacaaaaagaaattagccgggcatggtggcagacgcctgtaatcccagcttctcgggaggctgaggcaggagaatcgcttgaacctgggagtcagaggttgcagtgagccgagatcgcgccactgcactccagcctggacgataggacgagactctgtctcaaaacaaaacaaaacaaaacaaaacaagcaaacaaacaatatatataaaataaaaaaagaaatatagaaatataaaacacagggaagaaaacacaggaaaaacatcaacatgtctttgtgtttcctgatggggttttagtcacaaaccctaccacagagtctgtgaacaaaaagcaattatttggagtttgttaaaacttaaaacttctgctgtgtggaagacattactgttaaggaagaaagataacctaaggactgaaagaaaatattttcaaagagatatctgagaaaagacttgattccaaatattcaaaaaactgtggacattcaaaaaccaaacaaccacaaataacccaatttaaaaatgagctaaaggtctgagcagacacctcaccaaagatttggaagtgataaatgagcatgtgaaagaatgtttactgttatttggcattgatagataaatgcaaactcaaataataattacatgacactacacatctaacagaacggccaagacccccaaactgacaaaccaactgctgccaaggatgcagaacaggaacgtccattcatgtaaagtgggaagtctctatcttccagcaaatttggaagagagtctgcttggtccttaacaaggctcaatagtcttgccacactggtggtccagcattctcgctattaagtgtttgcccagtttgcttcaaaacgtacgtgttgtcaaacaaaatacaaatccaggattagtaaagagaaactttattcaaaaggatgagtagaaggaggcaagctatgtggaggggacttttacaggaggacatgagtaggtaaagcacaggtaatgctttagggcagtgaaaccatcatgtgcgttatagacagaatgtttgcttcccgcccaaattcacgtgttgaagtcccgactcccagtgtgatggtatttgcaagtgaggcctctgggaggtaatggggtttgaggttatgaggtcatgagggtggagtctttatgatagggttcgtgtcctccgaagaagaggaaataaaaatagctgtctctgtgtgaggacagggtgagataccctaatgatggttgtatgagacaaagcatttgtcagaatccgtggaaactgacaggacacagaatgaaacttaacgtgtttaatcttttaagacatcattagggaggtagggaactatcaggttgaaatgcagaatgtgacaaaaggttctaaccttaccaatgaatgaaaagcttcactgaaggctgtgaagtacaaagtgctgatctaagcaactttggaaatgaaagaagtgtgtaaggctaaagacaaaggcaattgtacatatgcagcatactcgactagacaaacctgttgccggtatggacacaggttgaaaaatctgacaccgttctccatgtgtactggaactgcaatgagtaaatggatggtggagggtgagaggcaggtttttcactgctggagagggaggtgcagatcgtaatgtggcaggggcaagaatgattcgtgctgcaatggaatagagttgcagacatgggtaggaactcatattcagcttattatagatcctcatggtcatgtatcaaaatatttatagaaatgtgtacatacgtgggttagtatacatacatacgtatttcctttctgcttcagcagagagggcctaggaaccactagactctggcagctacgagcacacctagttgccagacgttggtctctgataccattttctaataaaaggaaacagaaatccttggagaattggctgatcctaggagctagtaaataggccagaccagcctagaacatatgcaagacagaaatgtgcaggatgagccacaaagcaaggaattacacaaaatggagccccaaataatgggagcataccaacgggacctaggggtgaactgaacgtgcacccagtggccacaactgcaagaatgataataatgaaaaagaaatagcaaagtattggattataatctaaagtatcaagtaaatatccgtgaaagtatcatgatatacataaacgattgaataaggaaataaatgcaggagcatagatagctgtgccatgaaggagaattccaaagaatgtatgtagatactctgcctcaaagaaaggatttaaaacttagcaccagttaggtgtgaacttcgcttaatgacttccttccaaagagtagcatgtggacaggggttaaaagagcaacttttcatgggagcaccctgtccaacactgcttctgccaggtgaccaaggtcaacttacacaatcaaaactgatgttgatattatgtacccttgatgcgatcagacgaaaacagctctttacctttgtggtgattctccggtagctcacaacatcagtctaatcatgagacaagcattagaaaaacttgagttgaaaaatattctagggaggccggtgcaggcagatcacttgagtccaggagttcaagaccagcctgggcaacatggcaaaaccttgtctctacaaaacacacacacacacacacacacacacacacacacacacacacacacacacacacaagtcacaaattagccgggcatagtggcgcatgcctgtagtcccatgtactttgggaagcaaggaaccctgtctcaaaaaaaaaaaaaaaaaaaaaagaaaaagaaaaagaaaaaaaaaaagatattctagaaaatacctcactagtgaccctgaaaactctcaaggtcatggaaacaagcaaagtctgagaagttgtcccagccaagaggaacctaaggcagtatgatgattaaatgtagtgtggtaggctgcatggtatcttggaacagaaaaaaaaaatgatattaggtaggaagtaagtaggaaacctggaataaagtgtggactttagtttttttctgcctctcaaataccaccagtagggagcagttggggctgctgtgtcggcaggtaagccaaacacacaaaaatagcaccgcaaatgctctgaaaataaactttttaaaaatcccagaacctaaaaatggacaccagaatctacatgctaaacctaaagaaagtagctgacttctaacatcaaatatttgtctcctgtccagagactcctaaagtaacaagcaaaatacattgtatgccatagagcatagcccaccatgtgaagaaccaggaataacacagcttgaatgaggaaatagaatccagtggtaccaacatagagacgacgcagatgttgccattatctgacaaacattttacagcaaccatcataaaaatgcttcattatgtaattgcaaatagtctggaaccagactagaaaatggaaaatctcagcaatgagtagaagatgtataaaaaagaaatgatggaacagaaaacgaaaacaataacagaatttggaaacattgctggatgcactcggtaagagacctgtgatgacaaaagataccatcatcgtaatggaggcccaatcaataagattgacggccgggcatggtggcttacacctgtaatcccagcactttgggaggccaaggcgggcagatcaccgcgggccaacgtggggaaaccctgtctctactaaaaatacaaaaattagcttggcgtggtggtgggcgcctgtaatcccagctacttgggaggctgaggcaggagaatcgtttgaacccgggaggcagaggttgcagtgaacggagattgcgccattgcactccaacctaggtgacagagcgagactcttcctcaagaaacaaaacaaacaaacagaaaataggactgactgtgcctgagcgagagagagagatcgtggactgattaaaagctgaatggatcctcagcgaagttaggacaataacaaagttccaatatccctacgactggagtaccaaaagtagagagtggactgaaagaggagtataagaaaagaaggctgaaaatatccaaattttagtgaaaaccataaacccatagattctggaaaacgagcaaacttcagataagacaaccacaaagcgattcacaccaacacacacatcatagtcagtttttgaagctgataaaatcactgaaagcagcaagaccgaagtggttcattgattataggagaacaccagttttaatgagggcaaatgtctcctctgaccagtggcggtcatcaggaagtgtcccgaaaagtttcagatgttgaacaaaagtcctgtcagctgtgaattttgtatccagtgataccatccttcatggacgaaggggaaatcaagacattctcaggtaaaggaaagcattttgtcacgagcagacccacggtgaaagaatggctagagtaggtgcttgaaacaaaagaggaaagaataaaagatggcctctggaagtatctatcagaaaggagtcaagaccagtagaaaaaacacccttaggggacaaacactaagccaccgttttccttgtgaattgtggaagtcatgtttgacgattaaagcaaaaactatgaaaccatccgatactccagacaacgttgtctacaagcaggaaggcagaggggctaaaaggggctgatgcttctacacttcaatggaagtgatgagaactggataccaggagcctgtggtaagtcacatatgcacactgaaaatcccagagcaaccactgagacaattttacaaagccaaacactcgaaaacactttcggaaatcaggataaatcctgcaaggtgtacacgtaagccacagaagggcaaaaaaaggaggtctcggttagccgagacacggaggaaacaaaagaaaacaaacaataaatctgtggacctaaacactagcccagagatcatggaaatgaactagaaacatgtatgaaaaggtagatactggcagagtcagtgagaaacacggtctgattatcccatgtttatatgaaactcagttccacttcggtcgccctgggtaaatgaaaaggatacaacgggtgggaaaagtcacatcaggtaaacattaattaaaacagcagaagtaggtatgtcaacattaggtaaagaggacttcatcgcaacgaaaattacaagaaaaataaaacgctacagccgaataaaagaatcaagcccccaagaagactttagaagagtctttccgtgcccctcccacacgcccctccaattacagtgtgtgggcgttcctctctgttcccagagcccctggttcttatttctgtcagagcaaagtgtcccaaggtgttggggactgtatttgcatacacctgatcctaaatgaatgtgagtgctttggaaagcctgatgcatctccacatcccagcgcccaggtgagggtatctggtgcccggcaggtgtttgctgaacgcctcatgactgcctttcaggccagcgaaggctgttgtgatagggtcaagggaagggtctctttacatcgcattcaacaaggggccaatcctgctggcgcaggcaaggaggctgctcagcgactgacggggaaatgagggtggggtgtgggcacgcgctccggaggctgcaggcgccatgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccggacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaactatgtgtgttggtgtgtctataaagtccggcttggctatgtatggcaaggcttggtttttgaaggtacttggtctcagattatttcagaaggtggtggtgactctggcttttgtagtagagaaagcttccccagggtcccctaccttttgatgaggggaattagcagagggtttacacatttggcctctggggacacactacctgtgtttgaatcctggacctgccgcctgctcgctgtataaccggtatcgagtagattaaaccccattcctcaacttgctctttcctcaagaatgttaacagctaacagagtgtttgttcttggggtaaacacagtgccttgccttgactacctgatccatgaatgcttgttttctcaatttcaggcccccaaaactcctcctatcaaggcacccagacaatatgaaaccgcattgtttaggggcgtccatacacatgggaaaaccatgaattaggcagtgaaataatttaagccagcatcagattagggtttaactctatggaggaggaatggctttgagtgggggtggggggaggggagggtgtcctgcattcctgttcctcttgctgtgtaacaaacagccccacagtgagtccatacaatgacgagcgttgtatcatatgcatggaatttcagaggcaggaattcagaaagggcacagtggatatggcttgcttcacatgagtctgggacctcagctgcagaaacctgactggctggggactggaaccatctgaaggctcattcactgacatccctggtgcctgcatggagaggactggaagactaggcctggcgagtggagggcctccgtattaccactccgtggcctttggcttcctcacagcagggtgggcctcccagtagtcaggcttccgacctcatgactcaggctccaagcggcacttttccatatccaaggtgaatgttgcatcacctctcataggcaagactcagaagtcatgttgagtcaactgtgtcatactctattgattagaggtgagtcacagccttttcagattcaagcgtgggagggagattaaatcgcaggtctcggtgtgaacggggcaacttttatcacagcacgagagatgggagatatttttgtggccatacagtctggcacagtgggctcctagggagctggttatgtttcattcggttctcccacatggtggccactcagatgtgtttaacgggtcacatatttttttgtgtacagctgtgtatgattgaagacataataaggaaacaaaataggtgactgactcctatctctgagcaagaccaagagcagactaaatgaatgactggaggtacggagggaagacgacagtcagaagggggctggctggttagtcctggagccgaccttggccatgcccacgcaaacacagcccagggtagaagtcttattaacttcgggaccatcggtatttctgaccccccccagaaatctttaacttcctgctagttgcatatgctggactgcctcagccccacgccactgactgtcccttcccctctcctttttaagcccgttgttcacttgttcatccattccacaagcatttacagtgggtttggaatgtgtcaaacagaatgtgagaaggacttaaggctatggacaaaaagtggagttgggtaaagatgctcaagcgaggttcttagaatgtagctcagctcttccatagaataccatagggaagggaatggaaacacccccctctcagtagaatggaagagcgcatctggcaccgatccacaaaggccgcttgtttgtatgctggctcttcagatgacatcttaggatgaactccagactagaaggtgaatttcctttctgacaagcgtcaaggaaagacttagaaatgtgtttaaaaaggaaaattcccagcatgaaaccaaatggaagacaagatcactggtcataaaatataactagaaatagatgtaatgaaaatgtttattattatacataatttctattattttgttttattttttgagacagatattcgctctggtgcccaggctggagtgcagtggctcgatctcggctcactacagcccccacctcccctgctcaagtgatcctttcacctcagcctcccaagtagctgggattacaggcacgtgccaccacagcccgctaatctcttgtattatttgtagagacggggtttcgccatgtgaaccaggctggtctcgaactccttagctcaagcttcccgactgcctcggcctcccagagtgctgagattacaggtgtgatacataatttgtacatgtgcctttgaaaatgaaaaatatgaaatagacctaaggactctctctctctcacaaatacttcacgtgtgttcctttatttacttctcactaaagtctttcagaacacctattgttaatctcaattggtggagaaagaaactgagacgctgataatggaaggaccaagcccatggatgccaagagggcaggtggcaggaagaagttggaaagccagggtgattggataccatggtcagtaaggactggggaaaaaagtagctctcaggcacttctgccccattcatcctggcccctctctgttttcatggatccaactctctacgcatttcaccctatctcctcctcacatcaaaagcagctcttcatccctggccgagatcctgtggccagctgcccagtgcacgccaccatgacgcgggcctcctataaaaatctgaaatgaccgtagattggatgttctgctatttcatgagcccccacgttgtttcttcatgtgccaatatacttgtgtctatggccacaaacaacctgcatatcacagtttggaaaacacttattttgaggacagaggctttgaacggatatccacctgggcttgtgtcccaactctgctacttgttcctgcctgaaatggcaacaagttttaaaagttgcattcaccttctctgtgaggcttcagtgagagcatgcccatgaaggaatgatggagcctagcctatataagcacttactgcatatgagccctttttattcgtcttcttgttgtttgagcaaaaatccaaatgcagcttttgtcttaactgcacacagcctgaggtgtaggcagtacttccaggaccactatctcaggagccgtcatccacatttctttgatgtaaaaactgagcgtaaagcaattcagctacaaaaaaagtaggaggagggaagaacataggccttccagttccttattaagttccaactttccctagacactgtcgtctcccaatgtatggcgtgaggaacagagatagccttttccattcaaaactgtgtgacgggggcacgggtcagcaaagtacagggtcctgcaggagcacagcgatagggcaccctctgtcagacaagtcagtacaccgttctgggccttggtttcctcatctgtacaacggcgacagaattacatatatcttaatttgctgagcattttaagtgaagtgctggaaggagaatatagagctccatgccctgatgcgtcaaattgtcaagaaatgtcatccactgttcctaatataacttatgtcattataccccgatatttggaccaaagggacctagaccctatcgcttttgcctgggactccgcagtaagtgcctcaatgagttaccctaatacctttcccctcctctattatgaccaggatcaaggtttttctgggaatggcaccacagtttctgtgactccaccacaattcctgagacttgactctgagccactatcacagtctgcatgctcttcccaatgtgaggtgtgcggttggtggggttgatgccatcactgtctctcacttaaatagtagacttgaagtgagcgaaggctgttctcatgggtcaggatgtaaaagatgtaagcaacagtgacttcggacccaggagtggacattggagaaattgttaacagccggggggagctgcagataccagctggggaaaaccaaattatagccgcatggtctctgagataaactctcatcatcacaaggtggcaaattcctgcctctagaagacccagggagtttgctcccggcatcccagagatagttgtttaggactcgcatctctaaaataagtatttccagtatcacatgcaggcacaagggtgtccaccggaaaaaccgtcttgcctgagtatatcttcttgcacactggaaaatcttgcctagagacactttgacgaacattctctttcccattttctttctgccaacctgaataagatcttgctaagtatgggatattaaaaactatgtttcaggagattgcatttctggctacattggaggaaaaaaacaccacattgatccttcccccgcaaagcaacgaaataaccgagatgacaatggtttccaagatattggacctaatgcaatggaagagagctatctgcaagacagaagaaagagacatgtcgagccgcacgcctgtctcagcctactggcgggaggaggaactcaggcggagccacgttgtctccccgagttgtggggtacgtggtaggaacatgagtcctccttaaaaaggaaagaaatcctgccatttgtggcaacatgaatgaacctggagcatgtgaggtcaagtgaaataagccaggcacagagagacaaatagcaagtgatctcacttatatgtggagtctcaaaattggaactcatagaagcagagagtacaaatggtggctactggaggttaagggttggggggcatagggagtgttggcaatggatagaaaatttctgttagacagggggaataagttcaagggagctattgtaagtcatagtggttatactcaatagcaatagattggttatttgaaaattcgtaagacagtagcttttaggtgtttctacccacaaaaaacaaacaaacaaacaaaaaactgataaatatgtgaagggtggaatatgttaattagtttgatttggccattccacaacatatacagatatcaagcatcctgaggtacaccataaatatatacaatgtttacttgtcaattgaaaaataaagaaagaaagtaatttcacaaaatgacgagggaccgccagacgcaaaagaatggattggaccttacctcacactacatacaaaaattaactcaaagcagatcagagacctaaatataagagctacagtgataaaactcttataaggaaatataagactaaatcttacatttctcttccgtaagtcttacgttgtgaccttcccttaggcaaaggcttttgtgtgtgtctgcattcaacaccaaagcacaagcaacaaaacaaaaaagtagataacgtggagttttagacaacccgtagaaaatgcatctgatcatagatgtatccaggatatacaaaggactctgatgaatcaacagtcaaatgatgacctaattcaaaaaggagcaaagaatctgaatagacattttgccaaagaaagtacacaaatggccaataggcacacgaaaagccacccacaatcatcattagccagtagggaaatgcaaatcaaaaccacaatgagctaccacttcacactcagtaggatgacaagaataaaaaagacaggcgataacaactgctgacaaggatgtggagagattggagtcctcatacactgctagtgggactataacatatagggcagcctggtttgaaagaatttggctgctcctcagtaccagaaacacaatttccatatggcccaggaggtccactcttagctttctacaaaagagaaatgaaactctatgtccaaacaaaaacctgtacacaaacatacacggtatcattattcctagtggtcaaagattgcgagtggcgcaggcgtccatcagttgatgaactgacggatggaatttagtttctccattcaggggagtgtggcttggcaacaaaaagggatgaaatactgatacatgccataacatgcgtgagcctagaacacgtgatgctgcatgaaagaaaatcacaaaagaccacatattatgtgattccatttggaaaaacgtccagtatatgtaaacttatggactaagaaatttgatttccatttgcttggagaaggagaacagggtgggaagtgactgttaatgtgtatggggcttctttccaaggtgattataaggttctaaaatgagattgtggtgatggttgcagaaccttgtgaatatgcagaatgaaaagaaaaacacctgaattgtacacttgaaatgggtgaagattatggcctgtggattatatgccaacaaagtcttttttcaaaactaccatttatcgtccactttatgtacacttacctctatttatttccaaatgtacatgagtaacattcatgtccactaattggttgagacttttgaaaagcactgataacctgatgtatttttgggagatgagaagcagaaatcaatggttaacgtgtagtttggcaagagctgtgaccgctgtgaaacttcatttcctcatctttgaggtaattacttctactttgacatgacattgtgggaattaaataacaatgaatatgaaacattcaactgagtgcctgggattaacagccactccaggaagggtgaaactcatattacttactagagtacggggaggattctttaagaaggtaaatgtttaaacaatgtactgagtctagtatgtcaatttcttttttttttttttttccaagaaagaacaaggttcaaggtatctgtgacaagttaccctggtgagtgcaaccattttggagttataactgtgttcaagtcccggatcccacttactagctgtgtgaccacaggcgagtgactgaaattctcccttgcagttgtctcacctctgccaactctgcatcgctgccacagcgatactactaccttccctggagggttgctctgagaataagagattagaatgataaaaatggagtttgtcactcctgcattttcactttctccctttctaaggtctccttctcctgattctaaaaatgtattcaagtatccttcaacctaaataaccttcctttgtcttccgctctacctaccaaactcttcctcatttccttttaaatgaagtaccctggacttctcttcctcactcttcaatttcatgtagtctgtcttcattcacgtgggcccccgagctgtcccaaccccgagctgtccataaggtaacaaggatgtcctaactaatgaatcccaatggactcctctctcccttatgatctggccttacatctccacagcataaccctccctccttccttcacgtctgtggtactactttttctcctagttactatcctattcctcggagatttctctctccatctccttcctggacttctgtttccctgtgttcttcagtgttactattccctaggtttggtcctcggccagctctttacaggctatcttgcctacatcctggggtgaattaactcacgctcctggcttcgcctgactgattgttgagaggattcacaaacgtgtattcctggtctgaaagtaattgctgagcaccacactgaaacatccagttgccttctgtacatcctggatgttttcacaagcacctcaaacgcagatctatctctcagtgcactcccctcacctgcaaatgtgtgcacgcccctgtatttaatgcttcaactgagtactctagcattgctcagtcatccaacccagaaacgttcccttaccaaagaccggatgaacttaggcctgaagtcaagaaacagcagaagactggggaaaagtcagatgagtccggagaccagtaccacggacaatcgtagacatcaacctcaaccaagccctatatgggggtcagttagtctactgtattttcccaaccagctctctctccaactacctgtaatgaccatttattacacaactgtacgactctggaaacccctgatctcctttccctcattctcagaagctggccgcacctcctattttcctgagaaaatccaagacctcaggaaggactctctccatttcctaccagcaattgtaaacacctacctgcatgtacaggtacaagttgttgcctttcctccatttatgacagaacatccctcctgctctttccgggtgatccttcaatgtgtgctttgaatctcactgctcctatcttcccaggaatcttatagcatccatcatccatttactcccctgattgcccctgtcaacttcaacctgcccttccaaatatatctttccaatagcactaaatcacgcactggtcatgaaaaccttataatggtaaaaatcaacaatcaaacgctcaaagcaccctccgtcttctccattttaccctgcacccactacctcatctccttccattcacaatgaaacttggagctctccacacttgtcattacttcatcacctattcatcctacaactcattcttttcccccaaatcccaatgaaatggctctctcaaaggtcaccatggtgttcataatgttgagcacaatggaatgttctgtcctcatatcattttatagctccaactctatgaacaggaggaaacactcttctttttgagaaactaccattgagttgtcagtttgcaattttcctttgaatgggccatactttcaagttcccttgtaggcttttggattcttttgttgctgctgaaaactaggtctttgattgtggtaatgtggtaacactgaatattagatcctctaccttctccaggatttgcagttgctgatttctgaaagctgcagtcattgatttgtctagagggttttccaaactcttttgggagagcctgcattcgttgtcacatgtggccactgaactctctgttcctttagtttgttttctgcttgtattttgacagcaatttccttgacagcccagagcttaataaaaaaaaaaaaagcaaaaagttcctctgtcagcctttgtggattcgctctgggctgcagcactccttcaaacctcagccaggccacttacaactctgtcttggctgtcacttcctgtttagactgagtccagagatcagccggtgaaagcttagggtcttctcgggtctttcctgagcatgcatccaatcctgggcacgcacctggcttttgacaatccccagggtacatgactgcttccgaatgatctaatttcccaaatggcctgtccgccagcgtatcccccaggttttgggttatctgctataggtttcaactgtagtttctgcctcacgcagttgccgttttttgatttgccttataaggttttcaggagctgcccaagctttttctgccctgacttccctgttaggtcaaacagagaggagcattttgcttctgtccttcaggaagcccctggacgggttagaaccaatgaaaaccatgatttttgcataagctctgctctctccttccggaaccaggtaccagggttccacacgtgggatgcaggctgctgggtgcaatgccgccaccaggtcagggagaaggtggaacaagggcaaatgaaaatgctacaacgtttacctatgaaacactcagatggttgggagccttagaattttatttccggcttacaataattttacttgacatgtcgagacttataccatgccacatgctttgctaagtacttagcacgtagtatgttatttgagtcttacaaaaaccctatatggttttttcaatatctatatcactgatgaggaaactgaggccacagagaagttaggtcattgcacacaagtaacatgtggtagcacggccagtttcacgaaactgcaactaaagtggtcccacacggctccatgctcagaatgggtccctgggcttgcggtttagtgtggctgtcttgaaattcttaactatttctttccttgaatttgtgcttggtaggtgaggtgtgatgaaacggtgcagtgtgtgctggggtcctggagcctcagctatcatgtggtccagcttccaccacctccaggcctcactgggacaggttctctgctgcccaatcacccacccaccctctcagactccccttccctctgccaacccagcgactgctgctgcacttcaccctcaggagaaggcctgggtgtgggtgcagggaggggcagggtgggaatgccaagccacagggcagggctctggacacctgggaggatctccactcaccctatgcgtgtccccttaactgaggcagcaccacattaaattacaactacaaaaatcctgagaggtcaaaacagagattgagtcagaaaagaaagtgagattttgctgcttctgaacagtggaccccacatgctcctgttatatgaggtccctccttatatcgtttgacctgcttagtagagaagggtcacaaattcaggcttgcatagctccaaagcctgttatttttttttttcttttctgttctttcctttagcaaagattaagaaatggaataggtgatacatgcacacttggtgtaaaattccaaagtttctaaactatgtgcaggcaacggattcttctcacctccattgctgaaccatccagaactcattcccaaaggccactcctctttcccaccaggcttttagatacccttctggaggaacatcactggtattcaggcatatacatcatccaaactcctctttctgtattaaggcgtgtaccaaacgctgtgttgacctggcattttttccatctcagaatgtctcctggagctgagtgcggtggctcatgcctgtaatcccagcactttgggagtccgaggtgggtggatcatctgaggtcgggagttcgagaccaacctgaccaacatggaaaaaccccgtctctactaaaaatacaaaattagccttgcatggtggcacacgcctgcaatcccagctactcgggaggctgaggcaggagaatcacttgaacccgggaggcagaggttgtggtgacctgagatcgtgccattgcactccatcctgggcaacaagagcaaaactccgtcaaaaaaaaaaaaaaaagaaagaaaagaaaaagaatgtatcctggagtactttctgtgcttaatacaggcaaaagttatagcgtgcttgctatgccattgctgtaaatgcttcaaatcaattaaactcatcctcaccaaaacctagggaagtaggtgctttcctcattttgtgcatgaggagtgaagagcacatgcaattgacattacttgccgtaggtaatacttctaaacgagggaagaaccaggatttgcacccatgcagtgtagctccacagaggtaaaagcattctgctctatgccatgcctgcatggtatcctttgatacggatatatccttttctttatttagccggtgccctgttgacacaggggtttgcccaggcttaggctattacagacaataccgcatcgagtaaactaacatgttatatcattccatacaagtgcaagtacatccaaaggacaaattcatagcagcaggatttctggaggaggggggtaaagcacacacaatgtggacagatactgctaaattgccttctctaggtgttacatcaagttacacccatactaacaatgcaggaatgtgactcttcccatatcctcaccaaatcagtctgtttcaaacatttgcatatctgtccataggatagatcctggacagtattttattgtgcttcagaaacccatttctcttattaggagtgaggctgggaagttttatatacatttgggagctttttgtgtttttctttctgtgaactgttcaggcatacatatacagagactgactagctgtcctccagacctgttttcttttcctcctggggtttcccagcctcctggcaggtaactgtggctggtggactgaggcctgggcaatggatggtgggcccgagtggcaattctcccaagcatgattcataaaaacctcctatgagatcctcctactctttcttccccatctgctggaaagatgttgacacccagagcgacttatagagccaggtgttgaagatggcagagcttctgtcagcctggtcctagattgttttcaaaaagaagagccaaccctccccagtcctgtttccttttggaaaaatgtaggcaagaaaaatgttcatagtgttaggccactaagaggttggagttcatctgttacagcagctagcgttatcaatgacaatagagtaggcttagttccttttttcaaaaaatgaatccactgatggtatttacttattagggaaatccaccctttgtctgcgatatgattggcaagcacttttcaactttgcttcttgaattttatctttactttaggtggatttagcttgcagtatcttcttctagtcttcatgcacttaaacttattacctcttcctagtaggaattccggtgttgtgacatacctccaaagactgtcaactgcaacactgcatctgaaactctctcggagaggctcatagattccgtcttttccacaggttgtttcatcatgaatgaatgatgacttttaccaaattattttcttgtatctattgaggtggtcacatttagtttagttcttccctttaatctgttcaagtggtgaattacattcatttcttttctaatgttaaaccaaccttgctttgctagaataaatataacttggtcataatatagcgtattagtctgttctcacactgctataaagaaatacctgagactgggtaatttataaaagaaagaggtttaactggctcatggttttacaggctgcacaagaagcataggggcttctgtttctggggacgcctcagaaaacttacaatcatgtcccaaggccaagaggaagcaggcacctctatacaaggctggagcaggaggaagacagattaggaggtggtgctacacacttaaaggaccaggtctcctgataactcactatcaggagaaaagcaccaaggggatggtgctacaccatttatgagaactcggtccccacaatccagtcacctcccaccaggccccatcttcacacaatggattagaactgaacatgagatttggatggggacacacatccaaaccatatcatatactatcttttttttaaaaaaggacttctggcttttacagtatctttttaaaagatattgctagcctttttaacaagtaagttgtatgtgatattttcatatgtttttctgagacaaattgctttgaaatttgccattctcaaattatccttgtctagtttccatgtcaaggttcgcttagtaaaacacaaggggtattgtactcactagctctattctctgaaaaacttgtgcagtattggagtgatctctcacataaacattgacagaaccatctgggactagagattttttgtcaaaattgtttaattactgattgcatctatttcacatttacatttcaaatcatgtttttacatcttctctcagtttcagtattttaaatattttaccgtttgtccaattcctctaagtttttgatttattggcatgatggtctctaacggtgtgcctcccagttttgattcctgatattaccaatttgtgtgtttatttcttttatcttcacaagtctcacccgtggtttatgagttttatagactttttgttttttgcttcttgcttttgagacagagtcttgccctgttgcccaggctggaatgcagtggcgcaatctcagctcgctgcaacatccgcttctggagtacaagcgattttcctatcttaccctcccatgtagctgggacaacaggcatgtaccaccacacctggctaatttttgtatttttagtagagatggggtttcaccaggttgaccagagatggggtttcaccatgttgaactgtgctcaagtgatctgcctgcctcagcctcccaaagaactgggattacaggagtgagccactgcacccagctgagtttttacagacttttgaaggactgatgaagccctttgttaaaactctgtattgagtatttggtttctttctcatttatttctgtctttaatgattctttgtatttctttgtgtttattttgttgttatttttgtaatttctctagatggatgattaagtaattttcagctgttcttcctttacaattatatgcctttaaggatatatgtttccacctaggttaactgtattccctagctctatctgtgatatttgcattgccatccagtttaatgtattttataatttgcacacaggtgatgcaaagtcaggctacaagtgacagctgatttacttatgatttcctcctcctgactcaaaaagtgatggccattggggtctcagctaaaagtgaggaggtggtttaccaacatcaccacctttggtcagctctgagatatggctttcatctctagcggtgtcaccaaagcacagcttagttttacagctgtttcttttcaggtaggcattctgagtaaaagcagtttgaagtcctaggtttaatctgcaggtcctgccttcccttaagagatcctcactgtcctctgagtactgtatttgtttttgaatttttttttttttttgagcctgttgcccaggctggagtgcagtggcacaatcttggctcactgcaacctccacctcccgggttcaagcaattctctgcctcagcctcctgagtagctgggattataggtgcccgccaccatgcccaactaattttcatatttttagtagagacgggtttcaccatcttggccaagctggtcttgaactcctgacctcgtgatccacctgcctgggtctcccaaagtgctgggattacaggtgtgagccaccgtgcctagcctgtttttgaatttttaaacatgatttcacccaggctttgttcggttactattgccggaacattggcccttatgacctacttcccatttatgagagttaaagcctgagatcttggtgcaggtgcagattacaatatggagcagtcagacctatcttatttgttatttatgtagttctatgttcttattaattgcgtccctttgatctgagagggcctatttaaaatcctgtattgctaatttgtgtctgtttttccttgagtgttctgtatctttttctttaggaatgttggtgatatgttgctggtgcacagtaatcataagtgttatatctcccttggaaattgtactcttttgcaataaaatgtgcccttctttgtctgttttattgcattctaatcgtaattcattctggttagattttaagattgtgaatcacttttaaaaaattatctgcacttggccgggcgcggtggctcaagcctgtaatcccagcagtttgggaggccgaggtgggtggatcacgaggtcaggagttcaagacaagcctggtcgagatggtgaaaccccgtctctactaaaaatacaaaaaaaaaaaaattagcaggcgtggtggcgggcgcctgtagtcccagctactcaggaggctgaggcaggagaatcgcttgaacccgagacgtggaggttgcagtgagccaagatcacaccactgcactccagcctgggcaacagagagagactccatctcaaaaaaaaaaaaagtaattaattaattaattaactctgccaatctctgcctttaattggtgtatttaggcaatttacatttaaagtaaatattgatatggtagggtctcagtctgccattttattatttgttttctgttccctgtgtttctcattcctgtgtttctttgtttgcatttgtttggtctagtcgaatatgttttaaaattcaattttcactgttctgcaatacttttgagcatatcgccttgtatatttttttgaacacacttgttcttaaatttttgtggatacatagtaggtgtatttatttatgggttacatgagatattttgatacaggcatgcaaaacatagtaatcacatcagggttaatgggatacccatcacatcaagcatttgtcctttacgctacaaacaattcaattatactgttttactgatttttaaatgtacaattaaatcatttttgactgtgtcaccctgttatgctcaccttgtacctttttttagtggttgctctaggtattacaatatacatatgtaaccaccatctttgttatttaaagatttggcatgaagtgtttgcataaccttacttatgaagtttgcataatcttacttatgttaatatggttaggagttaggctttgtttaaagtttgctgtagcactaggattcaaaggctgcaatttcctccagtgtagttgtttttgtatcctgtttgcactatgggcttctctaagtattccctctctgagagagttttctatgttgcagttctttcagctataatttaatattattttactgatgccttgtgttggaaagatgtggggggaaagagggcattctgtaatatcccatttaaatctcagtggctttagtgagcctatttctctggcttctgtttttgtttttttcttttcttctcttttcttttcttttcttttcttttcttttcttttcttcttttttgagatagggtctcattctgtcatccaggctggagtgcagtggcgcgatcacagttcactgcagcctcaacctcccggaccgaagtgatcctcccacctcagcttcccaaggagtagctgagactacaggcgtgtgccatcatgcccagctaattcttctgtattttttgcagagacaggctttcgctatgttgcccaggctggtctcaaactcctggccttaagtgatcctcctgcctcagcctcccaaagtgctgggattacaggcatgagccaccacacctggcccacaagtgtcttctggtatatcttcattcactccttaggtgagaatgtaaagctagaggccgtttgagtaacaatatcctcccccatggctctggacaaggctctgtaaagtattccccacgaacacttagcctttattatggagaaggtgttactggaaagggatcccaatccagaccacaagagaaggttcttgtatctcatgcaagaaagaattaggggacagtctatatagtaaagtgaaagcaagtttatttaaaaagtaaagaagtctgggcacagtggctcacacctgtaatcccaacactttgggaggctgaggtgggcggatcacctgaggtcaggagttcaagaccagcctggccaacatggcgaaaccccatctccattaaaaatacaaaaaattagccgggcgtggtggcaggcgcctgtaatcccagctatttgagaggctgagacaggagaatcacttgaacccaggaggtggacattgcagtgagcttagaagtcaccactgcactctagcctgggcgactctctctcaaaacaaacaaacaaaccgtaaagaaataaaagaatggctactccaaaggcagagcagccccaagggctgcgtgttgccaatttttatggctatttcttgattacatggtaaacaaggagtggattattcatggctcccccttttagatcatatagggtaacttcctgacattgtaaactgttatggcactggtgggagtgtagcagtgaggacaaccggaggtcacgctcatcaccatcttggttttggtgggttttagctggcttcttcactgcaacctgttttatcagcaaggtctttaagacctgtatcttgtgccaacctctatctcatcctgtgactaagaatgccttaacttactgggagtgcagcccagtaggtctcagcctttttttacccagcccttattcaaccaaaattgctttgcctcaaatgcctgggataaaggctctgggcatattccagaatgactattctttcctgtcaaaaccataaaggtatcattctgaaatcactgtcagaacctggtgggattcctagtggtaagaccatgatagtgtggatcctgcatctccaagaatgcagctctccaaagttaattcaccctcatactaatccacactcaacctcaagctatttgtcaaaattacagtttaaattttctaccagctatggttcaaccagtttctgttcctgttaagtggatcttagctgtgatctacttagctgagatctacttagctgtgactctctggattcacctgcttctcaaatttcaggatggtggtttgtcctgacaactcggttgtctgctgggacctagaaaaattattgatttttaattttgtccaattttattctgtttgaaggatgagtgtgacaaattccaagcacattacatgtcagaatagcttcccgtttcctcagcaatacttgagtattgtctttagctcccaaatacttattctctctttctgaagctctggtgattcaaatgtttgatcttttgttttaatcccacagttctgtccatttttgtttacttgtttttccctgttttcagattgagtatatcctattaatctgtactaatgtacagattatgctgcattactgtacatgagtacagtacttatatacagattaataggatatactcaatctaaaaacagggaaaaacaagatataatcaggttcactgattatataaaatataaaacagggaaacacagatataatcaggttcactgattatatcttccatcatctccattctactgtagagcctgtccagcaagttattaattttgtttatcatattttttagttttataatttccatttggtcctttcctataatttctataacttgccagggattttcttgttttcatttacttcacggtaatccagacttacttcttcaagtaattttacattggctactttaaaatctttgtgtgatactcccaaaatctgactcatttctgttggtgtcagttgattgacttttcttgtttgagttgtgatttcccagttctaggtatgatgaatgatttttttattgtgtcctgtatattgcaaagagatccttaatcctttcatagcttctatttttgcacgaagttgctctgttaaggtttggcctgttggttctggcatattttcatgggctgtagttccaatggcatttcgtttaatgagccttttcaatgcagttctgggcttcattgttttactaaccccacttgagttcccgatgaattgctgtgggagctgcctatagaggcagaaggtgctttcctgggccacccagtgacattatgtaagaggtgtgggattcaggatccatagaatatagattatttccctggtctctttttcagtcatctagtaccactggccttcctaatcaatatcgaccagtttccccaggagagggaagtatgtacctgggccatctgctgctgctggttggagggccaggagctacagacctggctctcttctactgggggaagcgttggatatctctcttccactgggggaagcgtcgggagattctgcaactggttcaccttctgttgcagaatagatgtctggaaaatgccaggcctagttgctttctgctattgggtggaagggccacagataacctggcctggatcttctgctgccaagtctattgatacagacaggaggcagagaaatactgggtagaagatggcggttccccagcaaaggccccaccctcaagcctggaaaccgcagccctaaatgagaacggttatccctgttttcccgcccgaatgctgctttttccaaaaccacccttgctcgccatgccccctatcctgtacccattaaaaccccaaactccactggcagaagagcagagcagtgcagcagagaaggagagaagagaacaaggggccgaatgtctagaggagaagaggcaactgagcatcagagactacaatagatgtggcttgacttcagatggcaggactttggggaggagcccggagatgaccaggcttcaggggagatcaccttctcagctccccttcagctgagagccacttccaccgcttaataaagtctccacgttcaccttccttgaagtccctgtgacctgattcttcctggacactgtagaaatacccaggtacaaagagggcagggtgtaacagactgtcaccctgactccccactgagctggttaacatttagccatccacagacggcaaccgctaaaagagcattaattgtaacacacccctagtcactgccacggggccagggctcaaaagtgctcaccccagcctggcacccgcttgcctatgtgctctcccccctactacaagaggtttgagcttggaggcagagcaaaatgagccaccccacccccacactccatcacaaggcccagagggggtcaggagggaactgtcaggtctcactatgtctggacggttcttttcccttggatgaagactagggagacaatggccttggattactttctgccactgaagggagggcccagaggaaatgaggcttgttggcatcacctgtgcatgtggaaccacccacctgtaatcagcctgtgaaggtcactgggtgagttggccctctggggattagctgtagctgcagggaaataagacatgctgtttccttcattttgggatgcagagtgggttattctgcccaccaggccatgaatacccgttgcagctgctgctgattggttgattaactgaatatttatttttttgaaatagaaaaaattatgtgtgggccactttcacatccagtcacgactgtgatgaaataacttgttacaatcctactcactacagggaaaaagtaaaaaagctcgatgaaagaaaaaaatgggccaggtgtggtggctcgtgcctgtcatcccagcactttgggaggccaaggcgggaagatcatttgaggtcaggagtttgagagcagcctggccaacatggtgaaaccctgtctctactaaaaatacaaaaaattagctgggagtggtggcaggcacctgtaatcccagctactccggaggctgagacaggagaatcacttgaacccaggaggtggacgttgcagtgagcttagatggcaccactgcgctccagcctgggtgacagaaagaggctctgtctctaaaaaaataaaaagaaaagaaaagaaaattttacttgaaggcatcagagaacttattttgtgtccaggacatcagagtggaagaatctggaggttagagaaactcactgaggggaattcaactatcttgtgctgctttttccctcagataatttgctgaatcccaaactgcctgtgtgagaggacatcattccatatgcaaaacattagctaagaggtagagaagacatcagctcttcaggaaactcacggggctatggaaacaaaacttagagttcagacaaccaaacttgtgaatatttgagaagtcaagatctcaggaaaaagaaaagcagacaaaagtgagaccaatatggggtggttttcttcctaaaggcatttgtccacacttaagctacagaaaacatgtgactaagaagctcagcagacatcacttaaaagtctcaacagatttctcagaagtccccaggcatcagagaacttattttgtgtccaggacatcccctttgaccttccctatgatatgacacagtataaaagcccacaccagaagccaagcagattccagcaccatgccccttgagcttcccagcctgcagagacatgagctaagtaagcctcttttctttataaattacccagtctcagatattctgctataccgaatggactaagacatcaatcaaatggatacactgaaacatggagaaatgaaaattttaaacctgaaactaagaactcaatatttgagtttaactgagtactggaaacagaagaatagaaggagagggaaaggccaaacaggaatcacacatacgtgtaaagtttgttcctgagacatcacagatacaccacctgcatagaaggggcaaggacaaataatggtgaacatggtagctaatacctatggcaactaataccaataccagcactgtgtgatggacactgtctggactccattatccagagacagaatatacgtgtcacatatgttcaaatcattacatgaaatatgcctcacactgtgctgagcaaacaacagacctctttcccttcctctgttgatgtgtcccatggtgattttgggaatcttcagaagtggttatgaccagtggcacagggaaaaactaatatcccatgaagtcaccaatcagaatgctgagtaaaccacgtggcccctcctatttgagctcctagtccctcatacataacatggatataatgccaaattcttgctttgcagaactgttgtgagtactgaacaatgtagcaggttaaaaaaaaaggttgcctgaacacagtatgtggctcaattactatgaatttattcccttcagtccatattcaatccttgctcctgactgtgtttttgattctaggagttctactcctctctcactggctttgttgattgctgacccaatagcctttcccaccaatatcaggtggtaaaaacactgattttgttcaaggaagcaatctgtccaatcatggggggcccccttaagattcttctaatcatggatatcacaatcccctttgtccaatgatggttttcaacctcccttgcagctagtagtggatatgggacccagttctgcccagtgaggtgtacagggagtgtctgggaggcttctgtagaaaaagactgtttcttaaaaaggacagatgtgaaagaagagaatggtgatacttggaatgtaacagagatgcctggagccatgctatgacaagcatgaaatcaatagagtcaacttgttgaaaatggtgaagcagtatggaagccttgatgttttgtgggtctctgagcagctgaatcaggacacgtgtactttcaaccttcttatcacagaaattaaaagaatgaggccaggttgatcattggctttaaactttaatttaaactcatttgaaggtagttttagaaatactaatgctctggctccatatccagaaactctgatttcagcagtctatattgtgatggctttggacattttaaaaaaacattctgttttaaacactgtcaagcagacacatgacaagctattatgtgataaagaacctacatatagatcacgctccacttcaacagtcataaactcttggtcaatcttattcatctatacccactaacttcccccacccctccagcttagcttcatggaaattccagacatcctatcagttaacccatatatactgctgaatatatctgtcagagaaaaagacaacttaaaaacactacttaaaaatataatgtatgccattatcatgcctaaacaataatgaagaagtgccaaatatcttcaatatttattcacagataatatttctcttattgtgtcataaaggctaattttttcctttgagtttttcaactccagaccccatttagtctcacgcattgtaactggttgttatgtctgttaatctttggtaaaatccactctctccctctctttcttttgagaaatgagtcctttattctataatgtctcccacatgctgggttttgctgatttcttttcattgacattgtttaacgcactcctgtttcctatctttccagtaaattcagagttagatctagagtctccatcatatttagcttgatattttagcaaaaatacctcagaggcagagttgcataaatccatcaggggatgcatagtgaatgattgtctgtcctttgcaatgggagcagatattggtggtcattgcctagatcacttgtgtcatttgaggcttactgtgaagattattaacttctgtctatccttctttgttagacagaaatcttctctgataagaaacttctctcatcccctacttggtaatcaagtattatagtttatatgccaaacacagttaactgtttcaatttttgcctctgtttacccagtttcaaaataatgaatttattccctagcatctaatattttttagatatttttctttatttttaattgcctaataaaagttgtattgtgtacaacatgttgttttaattatgtattcattgtggaatggctaaattgggctaattaacatacgaattacctcactacttatcatttttttgtggtgaaaatacttataatctattgtcttttttttttttttttttttgagatggagtcttgctgtgtcgcccaggctggagtgcagtggtgcgatctcagctcactgcaacctctgcttcccgggttcaagtgtttctcctacctcagcctcctgagtagctgagattacaggcgcatgctgccatgctggctaatttttgtatttttagtagagacggggtttcactatgttagccaggcttgtcttgaactcctgacctcaagtgatctgcccgcgtcggcctcccaaagtgttgggattataggcatgagccaccacgcccagccataacctattctcttagcaattttcaagacctagaattttatgatggaggaaatgatattttcctttagagctaactatgcactcaaaattcaattgtatttgaatgcatgtcagttattatttttattgacactaaaattttccccacatgatgcaaacttcccatctgaatctgcctactagaacacaggggcagtcacaaagcaggtgcttagcaaatgtgtgttcaaagtatatcaaatgacttagtgaggtatgtcgacatcatacttgattgttttattataacattactgttctggtccttccaccagatgtttaaaactgacattaccactttgctgtctttggcattattcaggtattactgcatttggagacagaaaaactaagactcactctcctttactggatcttcctacttattagggaacaagtgacctccactaggctcatagatttgattatcttttggcttgcaaaattcatttcttcacattaccattaattatcattcacgctgtttgctctatgctagtctatgcagtcacctgctattgctctacttcccagcgacttgtacagctcaaattagcttgttccctaacatacttcctctttactgtagtaccagagctcctatgattgtagtttgtcaataaatcaccaagttcctcttctctgcttcttaatctctatgttttttattttccattatgggtgtgcattttgaggactaataagtgtttgggccttggccacatcaaagaatattttgtgaccagcctttttttccctcaaacttcaattttctgattgctaacatggatctaggagtttgctctcctgtgttattgtatgcaaattctgggatgtgtaagacatatatgcacatgtttacttggtgacttagtccattagtactactataacaaaatacctgagaccacataatttataaagagcaaaaatttgtttttcacagttctggaagctgaaagtccaagatcaaggtgtgggcattgcaagaattggggactgcctcagaatggataatatggtttggctctgtgtccccacccaaatctcatcttgaattataataatctccatgtgtcatgggagggacccagtaggaggtaattgaatcatgggggtgggatcttcccatgctgttctcgtgatggtgaataaatctcacaagagctgatggttttataaagggcactttcactacacatgctgtttctcttgcctgccaccatgtaagacgtgtcttgctttcccttcaccttctgccataattgtgaggcctccccaggcgtgtagaactgtgagtcaattaaacttctttcctttataaagtacccagttttgggcatgtctttattagcagcatgagaacagagtaatacaatggagatacaatttttcccttttaacctcaaacttgagctgtatttgggtaaggtattctcatgcttggatatcagacatttcagccctagctaagatttctgtcccatactttcctgtggtagtggtaggtactggtatttgaaaatgatgaagtttcttaagtgacatataattcccatctctgtggttctttgtagcttccacacatccttgcatctagcaccccagggccatacctatgaatgtgggttcacctcttagatcagaaaattgaggcagatagtggttaagaaaattaaacaaaacacaagattacatatggtaagtcttgcatttgaaccccagccatgtgacacttgtacaagtcagtgtttggttgatgttaacagaatgtactctgttaattagcacagggactaacatggggagttaggggtttataaatagtatacttctagggttcagagcaacaggttgttttgttttgttttgttttgttttttcccgacctctcagaataattaccacaatcatacagcacagttgactctcaagtagggctgccgcctctttcacagttgaagagttggggaatcaggaggcttccactgcaactgcaggttcttggcaaacagtaccttagttgatctcctggaaacaggaaactccaccagaagtgttggcccaagggagatatttttcccagctaggtctatacctccaagttatgcttgccttacctcacatttctctacacttagattggctttaagtggaatctgtctaaggtgcatcagattgacagaaggtaaaacacatttggaatcccagcagcaaaactctaggaaatggaggcttaagctttctagccatctcagcacagagaagcttatttgtgaatggggctggaacatacgccaagagaaccaatataaggcacagtgttcttaactctatgttcactagctcctcaatatttttctgttctcctcctttcagcctaccatacaccactgttacctaaacctggatgaaacttaagactctgcttgtgccccaagttgctcagtgatgctagatgtaagatggggaaagagaggaatctcaaaacctaaacatattatgtcctccagtctagtgctgttttggtttacctaaattctttaaaaaataattttattactcccaaatcagccacctcccccataccataagggcctattataaatcttcccctattcatcatttttcttattttagtcttccttcacaatttccagtctcctacttcaggaaagaaacacaaatcctcatgaaagaactacagtgaattatcctttctctcttaaatttattatatttccattctttccagataatctaagatttaaccttcttcctctatttgtgatttaactctgccaaatctccctattcctttctttatatatatatataatagatgatacaagccagtgtggtcttagaatcatattgtctgtgtttgaactccaagtccgctatttactagctatgtgacgttgagtaatccctggcctctctgaatgttattttcttatctgtaaaacagtgataagattaccttcttcaaaggatgatagggaaaattaaatgagagaatccatataaaataattgaaatatgatctacgcttaggaagcactcaataaaattgactatcagatagatacaattcaactatgaaatacaggcagagaatagagagagcatttatgcaaagaaaaaatctgtttattttaaatcatattgatggtggtggtactgagacaactatatgtgtaggtgggataaatcaaatgagtaattattttattttctaattctatctatctttccatgttatcattgagaaccagtattcctggtttggcaaacatttgtataattggtctggtacatcttgtcaaaccatataataaataaaccatcaaggactactagcatagtctcaaaagtgttcagaactcaaccagaagaggcactggcaaatgatcatcaataagtatagtaagcaaaatttatcaaaatgcctcaaatatatgtaaatccaataattcacaattatcccttttaaaatccttatttgtcatgtgtgtaggattctagggaaccaactcattattttttaaagctcctaaataacacgaaagaatcaagcacttttcctgcatttcctttgcaatctatatctgaaagtaacaaaactgttgaaggtaaattttttggaacagcactccagttaataaaaacagaaagaatgacagaagtgcaatatcacaattttgcaacctctaatgatatgtctctaaacaagtatcaataattgtggctaactgtaaaaagagtcacaacccgacctcatgtgcctcttgatggaaataatcaaaattcccttgaagtattcttgttaaaaaattgcacctgaatctgatcaagctcatagatttaattattgataaacaggaaatacagagaacaaaggaatattctaaactctaccatagacatacagtcagcaaagctgagaatgtaaaaaaacaaaaaaacaaacaaaaaaacctctctaccagtcacatcatccactttcctcaataaataaatgacatgaaaaaggggaagataggttgggtatccagagataaaaaagacttaaaagaaatatcaaaaaagcaggccaaattgaactgtagtgtctgagtgtacacatttgtgtaataaaactatacggaaaatcgtataggttattaccataaatgtcacaatagcagttacattgagaggtggaggaagtcatttgtgattgaacagggcacaaggaagccttctgggctggctggcaaatttctcttgacttggatggttgttacaagtgtgtttcctttctcataagtcaataacctataatttttaatgtgactttctgtgtttgtgctatattttacaataaaaaagatttttaaaggaggaaaaagattgaattaagcaatggttggatatcacctacactcttttttaaattttcctctttggtgaggaaaattctctcatttactgatgaactcttaggcagaaagactggagacaagcatcccatcacacaaaccaaaagatttttgtccaaggccaatctctctggacacaatctggtcagtgcttctctctcttgcgttgaactgcctcccctggaacctcatgaatgatggattatgaggacattcacagactatttctgacttctcctttatcgttctaacagtgaagtatcctctgttctctgagatatcactaagtagcagtcataccaatatgttcatgaccaatgcattcgacccaggtgaaggaaaaatcccagatgtctcctgcttccttgcatgaattaccttatgtgaacacggctgccaaaaccttgacaggttctcccagaaatgtccattctaggttcacacaatgtccaagaaggctccagcacttgtgtggagggtctctctgcacattctacctctcagttcttcctgtttattgtgaataggtgtgcacattctctttatgtcactgtaaataattaatccataaccggaggcaaaaagaatgaaggtgtggaaacagtacagagctagtataatagtggcagccccagagtgaaaacatcaagggtccaagtctgtcttttttcctacccctaaagtctggagaacacaattctcaagttataatcaggtacttggttttataatattttgctttgttgttggatttaaatatccaactatgaggccaggcgtggtggctcatgcctgtaatcccagcactttgggaggccgaggcaggtggatcacctgaggtcaggagttcaagaccagtctggccaacatggtgaaaccctgtctctactaaaaatatatattaagaaaaattagctgagcttggtggcggacgcctgtaatcccagctactcaggaagctgaggcaggagaattgcttgaacccaggaggcagaagttgcagtgagctgagatcatgccactgcactccagcctgggcaacaaaagtgaaactttgtctcaaaataaaaaaataaatccatctatgtgacaccatcttgtactaagcagattgtttggactgaatagtctttctaggtatgtcacaaaacctgaattcataaaagcaaaaggtgacagatttgagtacatgaagactaaaaacagattcagagaataagtttgtattttctatgtcagtttgcactaaattaatttacaaacaaggtcgctgaggctttgactcaactgttaacactttctgagagtgagattcttttgattagggtcttaaggtctttgttcatctcagaagtcttaattggtttaattaggctgacacctacagccctgtctcattaccataaactgtagaggggttcaacatgacactgattgtttcttagagcaaagccagtgcagtgagtaggattccaggccccccggaatgaagcaggaaaacccgaggcctgtggatgcaggatgtactagggaggtgctggggagtagtgcagataaacccagaattcagttggttggtaaaacaagagtgatctgagtcctgtgcttgtctacgtgatccaccattgaatggcaggccagccattgtgcaggcatctgcatatgaagtgactggaagcttcactggaacaaggatctccttggaaattctctcccctcagacagccagggtgcttaacatgaaaagaagttgtaaccctatccttaaactatagaagccatcagcagaagttacaggcttatgggggcccactggaaagggaaaatcaaaaggcctgtggatttcaaattaatgagtgatcttaagttgcatttcctaagttcggctacagactcatatatttcatgagtccctccctacccattccttgcctctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaaaggctcaggccgtctttatttgtatagcagtagttcatgtaacattatccataggttcttgaagactacaacattaagcaaaacaatgtacagcaggtgtacatcgtacaacaatgcacaatgtatgacattgttcaatgttgttatgacattgttcaatgttgttatgacattgttcaatgttgttatgaccttgttcaatgttgtttagttatgacattgttcaatgttgtttagttatgacattgttcaatgttgtttagttatgacattgataaggggaaaaattcattttgttagatgttatttcacttgaagtcacaatttccaagaaccagtggactatgttaagtgaggacttactgtattccatcaggtcccatcacgttaagcatggccaaattataggagatttggaccataggtttacaagactctttatttttttaaaagacagggtctcactctgtcacccaggctggagtgcagtggtgcagtcatggctcactgcagcctcaacctcccaggctcaagcaatcctcccatctcagccccccaaagtggtgggattacaggcgtgagccactgtgcccagccttggctagactcttaactgtactccatcatcttaacaaacacagctcttggttttgttcaccatgaaacttgtgatatgggtcacaacccaataaggggtatggctattgagaagataaatgcttgcaatggggcctttggtcattgagtaaaaactaaggattagtgactcctgggctgggaaatgagatgatgtcacctttgtctctttcatgcttgggttgataggaaaggtgggaagtcatttttaaattcagatcatgacctacacttggggtcagaggcactggatacttctctgaacaacttcttgaggaaaacaccaattatggattctgaggtggctacatttattggcaagagagtggccttataacctgcaaataactgtcaacaactaaagaaccttctgtcttattaagtgggtagtgccttaggcacagcagtatacctggagagagagacagtttgctttgctgtcaaacctcatactcatgagctagttgaataggtgtggggactgctggcacaacaccctgggctcattcatgctcaggtaaaggcaatgtatccttctacattgtccctttgtgtgtacatgtacctccagggtgtctaacctgtcagagatagccacactggtcttgttggagcatcagtattttggctgtactgcccataggtcttcagggcacccatgtgggaaatgaggatttttattttgtcatacataagctaacctaatccacacggatgtgcctcatacgtcttggacccagttttttaatcattagaatgtcaatggcaagagttttatttttatcataagagctctatgcactgaacctcatacaaaatacaaaccatccagtacttggtaagttttgccctggaagccactttataagcaattatttttgctgctgcatcaatctcattgttttgtaattttagtgatttaccagtagtattttgtggctgtgttccactgataggccaaaaccacaagccaggacagaactctttgtctccatccaatttggatgatttcccatcaaaaactggctcctaaatgtctttctcattagccaattgtttagcaatttccctaccagacattctgaactgtttatatataaatacaaaaaccttcagagaaaaagacaatttttggaaatagattttagaaaccaattatttgcatttcagtgagaagcagatcatccaggtgcttggagatactggactgtctctttaacaaagtagatacaaattcgtggtaacatttctttctaacttcctggatacatttctttatagttgttgatatctgatggtgttctccaatactccaaattggggccattcacagagtactagtttccctagggcatccaactatttataaaaaccatgttcagggcagtttcctttcagagatcccctatttcctctaattcaggtcagtttgatttaactgtcctcagagtttcatctccaattcctagcagccaagataatatggaatcttctcaaatctggttgcatactgtaagtactttatgaggttcctacttcaggctttctcagtgtctacccatttgttcttggcaatttttctcccaattttccttctttattcctctggtcattatgggacaagtctgaggagatttaaggaaaggggccaacttattctatacttcagcaaagacctgaaaaggaaaaaagggggaatgtttgggctggatagaaggtagtagaccacattgctcactttgagcatctttccctagtacctaggaaaaacagccagtgcttttactatccactaaagcctctgttcctgtcctcaaaagacaaatcctctctcaaaatagaccctcctttcacaatatcatgattttgattcattgcagtgcaagaacttgccctttttatcatttacttataaacattttgcggtatacatactcattttagtaaaatggggctgtaaacaaactatccaacaaccacataagttctgtcaaaacctgagcatttgagttgctccagtgcctgttttcatgtccaatattactctttctatattttctgttaagacaattgccattttttttatttttctagttttcagttacagcatctactcattggccattgagaggaaggagaatttgaaccaaggcttctccccagggacaccactggttacttccacagaatggggaaagtgaacttaccttagaatttgggagaggctttttcaaaacacctcgtgtgtgtgtgtgtgtgtgtgtgtgtgtgtgtgtgtgtgtgtgtgttcagcaaataaccaaaatcagcaagggaaagggaaaagaaaagaagaacctgctaaatgaacatgccatgtatcagaacaaacagaagggaacaaaagctctacttacatacagaagacacagcttacaacgctacactacagatcctgtaaaatactgaatattggccccccacacagttcagtcctgcactagactatgccagactgttttagagaaaatttatctaaattctagagagattctcttttcccacacttagcctttaaaaattgtatgatttctttctataaatcagtgttgataaaagcttcaggctttaagactcagacatcaaacaaaagggatttctgcaaagccccttgttttctacttggattaatattaaacactaatactaaatttgcataaacataatttgcagacatttctcagccctctaaagaagatgtgtctctctttgattgctgaactttttccaaagtccaagcagataatattgaaacttggccttggttttggcatacaagtacagaaaaagatttgttcatagtcaggctgctgtacacaatcatgtcgttacgtctctcacgtggtaagatatatatacaaaatatatgcaattatagcccttctttcacatttggggcattgagtaaagggcctcctctattctctaacagaaacttagatgaattatctcctcctgagacttcttttacttgttctatggcagtgtaacagtgaccttttgccaaaccaataaattcacaaaagaaggacactttgtcacacggcaagtgaccaaaaaataccccaagtagcttctgtgggtttagctggcagttcctggattcaattttagtgtttgatctccacccttgaatctcttttttgtctcttctttaattgatgcttctatcactttctaaactgtcttaatttattttgccagtttggtagtgtataaacgaatggtgaaacaaaacatatcattacttttttttttttttttgagacagagtttggctcttgttacccaggctggaatgcaatggcacaatctcagctcactgcaacctccacctcccgggttcaagtgattctcgtgcctcagctccccaagtagctgggattacgggcatgtgccagcacgctcggctaattttgtattttgagtagagacggggtttcaccatgttgatcaggctggtctcgaacacctacctcagcctcccagtcattacattttttaaacatccaaagacttagatcctgagtgatgttggtgacagaatgctccatccccaaccacattcttcaatgcatgctaaattaaaaagaactcttgtctgagaggatctgagagggtaggtggtccacaagcataaatttgacacatttaagaagtgagtgagggtttgaaggtcaggaggtatatttgaggaagccctaaccttaaaggatgatgattgcagccagacgaaatgtggcttcccaagatcttcgtggggagtaaaacatcatagtgaccaaatgttaagtcaggaagaactgtttgcctccatggatggcacactattcaaggcctggaggaaaactaggggcatgagaaaaataatacttatttgctagcagaatctgagctgagcttggaggtggctagggaatgaatgtatatcagattcattccataagacaaagaagtcaaagctgctggcaatacagacagcatgggagccaactctgagggtggtgagattgccaagcctcacagacttccatgtacaagtattagactccacatatctaccaatgcctgactaagttagtggcacccaagataccacatatgacctgagtgtgcagcctgtcagtagctacaatgaagggcaagttctgctctgggccacccttgggccctcaactctgccaacagttcccaccatcagactgggggccaaaatcaaaatacattctcctcccaacatgaaatatgcctagcattgtgctgagcaaacaattgaccttttccctttccctgctggtatttctcatggtgaacttggtatccacagaagtagctatgatccatggcagagagaaaaagtaatgaatgccctgtggaaccaccaattagaattctgagcaaagcatctagcccctcccctatgagcctcttgtccctcctgcataacagtgatataatgccagttacttggtttgtagaactgttgtgaggaccgaacaaggtagcaaatacaaaaattgcctggatgcagtatgtggctcaatcgctttgagtttattcccttcagtccatattcagtccttactcctgactgtatttttgactctaagagctctgcttctcccttctcactggatttgctaattgcttacccaacagcgttttctactaatgcccagtgataacaaaaactgattttgttcaaagaaggaatatgttcagtttcggggcaagggtggggaggctcagaaattctccaatccaagcatggctatcctattctccttggttatatgatggtttttccagcctcccctacagctaggggtgaacatgtgacccagttctgcccaatgaggtgtacagagaatactttaggacttctgtaaaagaggctgtttcttaataagaaggacagatgtgagagaatggtggtacttggaatgtgatagagatgcctggagctgttgcagccacattgtaacaaacatgaggtcccagagtaaacttcatgaaaatagtcgagctggaatatggaaactgtggtgtccttcaggcatatttgagcaactgaaccagtgcaagcatacttccagacttcttatggggaggggaaaaaattaaggtcctgtttgtttatactgtttgctctaaactttaactgcacagtaaatttatttgaaggtagcatttagaagtgctaatgccttagccccatatctagaaattctgatttcattagtctatattgtgactctgtacactttttaaaactttctgttataaatagtgtgagatacatggcaagatattatacagaatgcatgtagattttacacagcttcattagttaataactcttggtcaatataattttatctaaaccctcaccaacttctctccacccaaagattagtttgcagctaatcttaaacatcatatcacttaataaaagattatttcagtatgtatctgtaaaagatgcagacactttaaaaaatataaacaataatattatcacatgtaaaaaattagttacaggctgggtgtggtgcctcatgcctataatcccagcacttggggaggctgaggtgggtagatcacttgagctcaggagttcaagaccagcctggcctacatgatggaacctcgtgtctacaaaaaatacaaaaattagctgggtgtggtggcatgtgcctgtagtcccagcaacttgggaggctgattggggaggatggcttaagcccagaaggtggaggttgcagtgagccgagattgtaccactgcactccagcctgggcaatagagccagatcctgtctaaaaaatattaattataattcccaaatatcttcacatactcattcctagttcaaattgtccaattgcttataaatatttaatttttgaaatttgattttcaactcaggattcaatttactctcatgcattataatttgttgaatctcttttaatctataagttgccccttctctgtttttttttccttgcaatttatttgttgaagaatttgggtcctttattctctagagtttcttacagtctggcttttgctgacatccttcctttgttactgtttaacatgtccctctgtgtcctgtcttctctgtaaattggttgttagagctacctgggaagtgtctggttatctccttttttagcagacattgatgattattggctagatccaatatttcatcacagattgtagaatgaagatgttccatttatctttctacatttattagctaagatatgtctttaagaagaatcttcccctcatttactatttggtgacacagtaaatagtatatatgcaaatagaaggctaattatttgattctttccttttatttactggttttcaaataatgaatttattccctatcagttttagagatgaccacaaagtatattttggagtcattatgaacacaatatttaaacacacttaatgtgtttaagtctgtttagttgttattcttatatatgctcaaactgttccatttttaggcattcaggctcttcaggttggctcttgaattctttttacattaccccagtagtctgtgatagcttcctgttttcttgtacatcaggttgttccagtctcaccttatacatttcccaaaatcagctcattcattatgtactgatttttttttttttttttttttttttttggtgagaaatgcttttttagagagtaaaatcatcaggcttaactgcatgccactgggttcatcatggtttctggtgctttgtagagtactgaactaagaaatacatatttaagcaaaatacatcatgagtttatactcataattcccattcaaatttagggctccagcatacgtactttatgtcattaattttacttcggtatatcctttctatgaagccacaagtactgactcccaatgatgccaacaaaattactcattagtattatcccccaatttacacctgacaatatctgaaaaacatgccaacactaccattaaaaatgctaattctgaaaacagtttaaatattttgtgtggttcttttgatcctcaggttgtatctcactaggaatagaatgtacagaacaaatgactatgtttataaaccatttgaaatagtttctctatgtatgataatgccaccaactaaatgtaaaataaaatcaattttgcttttcattgataggaattattttatattatttaattagtttttataaatatgtggaaagtttacatagtaccaaagtcaaacctacaaaacaacacatttgagcaaagtcccccttgtattcttgtccctctcactctgaaccttctttcccctgggtacatttttttctagtttgttgattataattccatatatggatttattcaccatttttgctaaataataatacactatgcagttttctccaacttgattttttttgtttaccaatatatcctggagagtgctccaaatcaacatatagaaatagttattttttataattgcataatattcaattattttatttgtcaagtcctctattaatggttatttaatcatcccaattttttccataacacatacttccataatcagcaacattttcatatttccccagtgtttctttgattttgagaattgggatttataggccaacatgtattcatatatgctagatcttgccaaattcccctccataagaattttgcctttttgtagggagtttagtctttttaaaaagtttctcaggtgattttgtgacttaaaccactggtttaagtcattgttactgggtttttgttgcttgttttgttattgatgctaaacacataataacctagtgtaaactacataattggaatcttcctactagatccaatactagtagagatcacggactgtgctgtgttcttaatacccacagtggctagcacagggactagaacaaagcttattaaatgtatgttgagtgttaaatgaggcagtgaaatgtagtgacatcaccgttaatctatttcttataaaaaatatattactgtgcctgcctctacatcagatgtttcattctctgaaggcatgaagtgggtattattgatacattaatgtagcaaacatttatttagagtgtaccatgtgacagtagtattctagatgatgtacatagaataaaaacaaaacaggcaaaaatctatgcccctttggagtattacattttagcagaatttaaagaatttaagaattgaatataagcgggatagtacttagtgttaataagaatattataacagtgtgaccatgagactgacagggattttaagctgtggctagacctgcccatgccttttaagcagaaacctgaattaagtgaaagatggcttggcatagagggcatctttgaatattcattgaattaatgaatatgactgccaagagaatcttctgcctctggctatgtaccagtcaccagattagggcatctctccctattcctgtatgctaagttcctccctttccatcccctaaaatgtcccataagaaatccacctgggacaaactggacctccggatcctgagtgataagctgggattacaggcatgagccaccgtgcctggccataattgacttagatttaaattaaatctttttacttccacttattaatgatgcaatagttttttcttgctctccttttccttgttcctttttcttctcttttaatgctctctttctgtctcaaaatctaaaacgttttcatattctttcaccctagtccccaaactttgtttttgtctttgtaaatgctgaaagtcacaattcccaatgaaggcaaaacagttatgaatatttatgcacaagataacacatgcatatttttataaagcacaaattataggagatgcagggaggaatatacaggaacatgccaataacagagtataacacaactgtccaagacaggccaaatggacaaaaaataagcaaggatatagaagacctatttcacataatcaataaggtagatcttctggatatatatcaaactttacaactagataattgaaaaatactttctcaagcacccaaggaatattcataaaactttaccatattccaggtcacaaagaaagtatcatcaaattcaataatgtagaaataacacagccagcattcatttgtcataatgtatagctaaaaaaataagtctttcccaggttaaattttaaaactctctacttaaagcaaaataaaataaaaactcctgagtgaaaggggaaatacaaaccaaaattgcagttttaaaaaacaaaacaatgttattagaaagtctacgtagcataatatgtgtgatacgtatttcaaccctaaagttaggcaaaggtcaacaaagtaaaccaaaagaaaacacaaggaagcaataataaagataaaaggaagcactaatgagacaagaaatggaagagcaatagaactaaattaatcaaaattctctttccttaaaataaattaacatcatgcttaatacctaatatattacttaatataataaaccactattactacttaatataataaaaaccactacttaatataataaaaaagagaaaacagagatacacaaaataaaaaatgaaacggaataactattaaaacagaaaaaaatttaaaaaataataataaaagactgttttttcacaataaattgaaaacccaaaggataagtacgatttcctaggaaaaaataattcatcaaaattgacaccaatagtgatgaaactcttaaggaccaattttaatagaagaaatcgagagatttattaaaccacttcctcaaaaacaagtatcaggctttaatatttccacagggtgattttaccaaaatttaagcaccaactaatcataacgctacatatgttattactctcagtgctacacaacattttccaaagcatagaaaataaagaaaaattcaaattactattataaagcaaatataacattgataccaaaacctgatggagacagtataacaaaagaagttacagatcaatttcaattttgaatattgatacaaatctcctaaattaaatatgagtggacagaatctaacaccacattaagaaaataatgcatcaggaacaagtaggatttattccaggtaatcaggggtgattcaataattaaggaatcaattaatgtaattcatcttatgataggtctaagaagaaaaagcatatgaaaatttccagaaatccttataaatccttataaatgttcattccaacaaaccaaaacaaaacaaaacaaaatgaaaaaatactcaataaaatgatgtatgcttcatatatattatgtatgtgtgtatataacaagtatatgatatatacacacatgcacataaagaagtacccactgtatgtctgaataactacaaatgtaaatactaaaatttctaatggaaaacacaagaggcattcctgctaaggttaaaagcagggaaagagttgcccagtctctcagctattcaatttgttggcggtattagccaacacaattaaaaaacaaaccctacaaaaacaagtataggcatgagaattacgaacatattgtaattctatttgtagattatatggtattttacttggccaacttgagaagtgtaaagatgaaactaacacaaacaataaaagatttgaaaaatttagaaggatataaattaaaatacaaattcaatgactttacatacttataaacaataacaagaaacaaaatataatgaaagaaaaaatctctgtaataacaataaagaagataacaatcttaggaataactgtgacaaataatgtggaaaacctgtgtgaggaaagatttaaagactcctgaatgctctaattcttatataggaaagttaacattattaagatgtcagctagtttataaacttaatgaaatcttaattaaaaatatgccagcaagttttcttttctctagagaaagacaagttgattctaaagttcctcttgagggtgagggaaacaccatgcaggaacagctacaacaatctctgaaaaaataatagcagtgaggaaagactaacccaaccaggaataaaacatgctattaagtctcaataattaaaattgtatggtactggcactccaatgaacagaatagaaatgtatgaaatacacccatacacatatggaaaattcatatataataaatgtgacaacatataactagggaacagaaaaacatttttaatgaatgctgttaggacaattgggtagccatttggtaaaagataaaatttgatccataactcgtagaaagaataatctccatgtggtttagagatcctcatgtaaaaaatgaagttctttaatactagaagggaatacagatagattctgtaataacctgggagcgtggaaaggacttctatcaaggaatccaaatccagacacaatcaaataaaaattgataaatagcccctccagaataaagaagaagacacattttggcctagcaaaaaatgaaaacaaaaacagagaaataaacaaataaaaaataataaatttggagaaaatattttcaaaatatattttaaaaaagctaatatcctcaataaatgtaaagcactctttaaaatcaaataaaaaaggtcataaacccattacataaattggcaaaagacctaaacaaatagtttacaaaacaagcccacacaaatggccctgaactatatcaaaagatggtcaaatctactcataattacagaaatgtaaattaaagctactttgaaataccatttctcacctatcaggttgtctgttctctgtttctgtctgttgcaattcaggcaccgttatttcaaacgtttattattttaggtttattatacagtacactgaagaataagctactgctaatcaagctacctataaagaacaaggagtagaatctactagatagaaagtgctcgaataagcactaactatctttatttcagttcatcccagtcatgaataatatatcacctgggtgctcctccaacagtttgggaaacaattggtgtcctccatccagtacacccccatcatgcaagcactccacatgtgcacacacctgctaacaataataaaatttccatatttgcataatcatctcccaattatggagccaaataacttataaggtagtgagtatctttgggaaaagaattttgttggctctattttctcactgagctgacaaagaagaggatgctggcagctcaggaaaagctgcctttggtgtgtcaagtctgaatgagactgggtcaagtgtatgagttaccatgacaacgacacgatcaggatgcatcatctcccatagcaactgcattgagggggcctagtgtctgagtcgaagctttctctcagcatcagaccttatttgaatccacatctaaagctacaccctggggtgctagctaaaaggatacatggagaatataaagaaccacagaggctagaattatataactaatttcagcagcttcatcattttaaacccgtcactactatagtaaacccaccactactatagtaaagtgtgggacagcagtctaaacgagggctgaaatgcctgaaatagccaagcatgggaatatcccacccagtaaatagtccagttttgaggttaaaagcaaaaaaaatgcatctccattgtaaggcagtctccatagcctgcaatgtccacaccacactcatctaatgcctccaatcctaggtgacaatggaactacaaaatcaaagctgactctataatccctgctgttttcagactaattcacacacaattaacgtggagaatatgaaaaatttccccaagtgggattattagtcatgcagcccttttcaatttctaccggtacccaaaactgctacaataaaatttagtgaaacaccctcaagaacagaattgcctgatagccaaatgctggactagcccaccagaaagtagcctacttttggagttaaaaggtggaaagagtatctttataggttaacatgatggcaagccaatccctgcatatatcctgacaaaccctgaagaaagtattgttctgttttctcagagtaatagggtaaatgcaagagattgtgtaattcccctacgttaaatccagcacttcttatgtgacaacctatatccaagcaatcatgggtacaaatgtcttacatatctcataatttgcatgcttcataatgtgctcgcatcttttgtagagctcgtttcacaatgacacagaagagtaaactcctagcctcatgtcaaaaatcagaaaattgaagttttagaaaaaagaggctgatcaccaaagggtctttgatatgaccaacacccaacacccaaacactcattagttctcaaaatgcatacccataattgggggaaaatatcattgaaaagcagagaagagacacttggtgatttactgaccaactacagtagtccctccataaccatggggaaacggttccaggactccctccatgaataccaaaattctcagatgttcaagtccctgatataaagtgcgtagtatttgcatataacctacacacatcctcccctatactttaaagtaccttctgattacttataatacctaatacatgccaaaacatcactcattcatgtggattcaacatagtattcagcatgtagcaaattcaagttttgtttttttgaacttggtagaattttattttttttcaagtgcagttggttgagcccacaaatgctgcgtaacccatggataccgagggctgactgtacttccataagaccactcgttctatggtaagaaggaaatgtactagggaatgaggaaatttgagttatgcaaggctcagcaatagcagatgactgcacagactagcacagagcaaacagcgtgaatgagaattaatggtaatgtgaggaaatgaattttgcaagccaaaagataacaaacccatgagtctagttgaggtcacttgttccctactaagtagaaagatccagtaaaggagagtgagccttatgcagtctccaaatgcagtaatactttaataacaccaaagacagcaaagtggtgatgtcagttttaaacatgtggtgaaggacaggcacagtaatgtaatgttataataaaacaattaaatatgatgccaatacatctcactaagtcgtatgacatacttcgagtacacatttactaaccacctgctttgtgattgcccctgtgttctagtaggcagattcagatgtgaagtttgcatcacatggggaaaattttagtgtcaataagaataataactgacatgcattcaaatgcatcaaatatgattacatctttagtccatagtaactctaaaggagcaatgaccacatgtctaccattataaaattttagagaatgaattcactatgccaaattgggtaaagagaggcaaatagtgaaacaattgtcctgtgtttggcgtatgaattgtatctcttggttaccaaatattagatgaggttagttctcactattgaagaattccagctaataaaaaaaaacagatataattaaaacatctcaattttaagtctcaaatgacacgaatgatctaggcaaagacggccaatatctgctctcattacaaaaagagggacaaccatacagtttgtgactcctgaaaggctaatgtgacactgtctctgaagtattcatgccaaattatgaagccaatagatagatataacttccaatttacaagaaaggcaggggacaaaagagagtgttaaacaacaccaatgaaaagaaattagcaaaatccagcatgtggaagactgtagaataaaggattcatttctcacaagaaagggattttaccaaggattaacaggcatatcaaccaattgcatgagaccagatgggatctggagtttaaaaaaaactacgtgaaaacattaatgatacaatacaggaaatattatctgtgaataatattgaagaattaagcaactattcattattgtttaggcatgataatggtatgtatcatattttaaagtagtatttttttaaatgtctttccctttgagagatatattctgcagtatatatagattaactaatatgtctggaattttcctgaagctatgctggagtggtgggggaacttaatgggtgtaaaagaaataatattgacaggccggtcgtggtggctcatgcctgtagtcccagcactttgggaggccgaggtgggtggatcacaagttcaggagttcacgaccagcctagtcaacatggtgaaatcccatctctactaaaaaaaaaaaaaaaaaaaaaaacctagctgggtgtggtggtgcgtgcctgtggtcccagctacttgggaggctgaggcaggagaatcacttgaacccaggaggcggaggttgcagtgggcagagattgtgccattgcactccagcctgggcaatagagggagactccatctcaaaaaaaaaaaaaaaaagatttagaaagaatttatgattgttgaggtaaggtgcgatctacatgtgggttctttatttattttttttgtttttttgagatggagtcttgctctgttgccaggctggagtgcagtggtgtgatctcggctcactgcaatctccgcctcccaggttcaagcacttcttctgcctcagccttccgagtagctgggattacaggcatgcaccaccacacccagataatttttgtatttttagtagacacggggtttcaccttgttagccaggatggtcttgatttcctgacctcgtgatctgcccgcctcagcctcccaaagtactgggattacaggtgtgagccaccgcgcccagcagtgggttctttatcatataatagcttgtcatgtatctgcttgatagaatttataacaaaatttttttttttaatgtccaaagccatcacgaaatagactactgaaatcaaaatttctggatatgggccagggttttagtacttctaaaagctaccttcaaatgagtttagagccaatgatcaacaaggcctcatattttttttcttgtaataagaatcagaggttaaaatacaaggagatacaccaggggcatacattcacagagggacaaccctgtgaagaggtaacagaggggaatcatctgcaagccaaggagggacacctcagaggaaatcagccaggctggcaccttgatcttggcttccagcctccagaactgtgagaaaataaactgtttttaagccagccagtctgtggattctattatggcagcccaagcaaactaatacgcttccccatactatccctgctgcccattctgtagagccgactcacacatgataagtaagattgcaggaactcagttgtgcactgacacaggagctgaaggcctaacactcttcctgggaggctgtgaggcttgacgattttaccatactcagaagtgctgccatgctggtcatgttgccggcaggtctggccataatcgcaaggaacgaatctgacaaacatttggttccatgagctccagaagagcccagcttacgccctgccagaacatcaaagaaagatcctagaaggcctttcttatgctccacaacttcccttcatgccaacaagagattgccattcatagaggcaaatagctgttatttattgtgttgatcccttaccatgtattttatttttacttattttttttgagacagggcctcactctgttgcccaggctagagtgcagtggcgtgatcttggctcactgcaacctccgccccccaggtttaagcaattctcctgcctcagtctcccaagtagctgggaccacaggcgcccaccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccacgcccggccccaatatgtgacccttttgcttcctctggaacctactgtagacttactaacctttctaaataggaaatcaaagcacagcaagatgaaaacatttctgttcacagtagataatgtaggtaagagcaaaggaagcagaacggatcaaaggatgtcccttgtttattaatctgattatatcttgtcaatatttacatgcttacctattagttataaaatctgtttagcaatagatgaagtgaaccactcagatctgaaaatgagaaaagaaaagtagtggagtgtcaatcatcttggcgtgtaaataagaaaggtgttggccgggcgcagtgattcacgcctgtaatcccagcactttaggaggccgagggaggcggattgcctgaggtcaggagttcaagaccagtctggccaacatggtgaaaccctgtctctactaaaaatattaaaaaattagctgggcgtcatggcgtgtgcctgcaatcccagctactcgagaggctgaggcaggggaattgcttgaaccagggaagtggaggttgcagtgagccgagatcgcgccactgcactccagcctgggtgacagagggacactctgactcaaaaaaaagaaagaaaagaaaagaaaagtatcacctaaatgaatagaaacagtgaacaggttgtgtccacagggtttgacattggggcaaacctctttttttctctgtcccatctaaggtgactgagcttccctggaaatggctgggaggtgtaagacatctctgctctcatcttgaaataattcatccactaaggagagaaatttactatcaaagttccgagaaattcgtgtagataatatattatttcatttaatttaatctttagtagaaaataaatgatctatgacgaaaaaccctcttaactcttttctgcctggtagaattcagaacatctcactccctcatttattgaaacaccacatctattatttggcaggcttgtcagtgggagaagaatcttacttaatctttgcctcaacactctaaaatacccaagatgtgactgaaaatgcatacaataaattatgcacatgcctatagtgggctactaaaggttggttctaaattattcataccagctcaaatgaaaatggaaaactagttatttctatcctttcaaatatatttatgggaagaaaaagtgtgaatgtgattaatgccactgaattatacacttaaaaatggttaaaatggcaaaaatttttatacatatgtaaacaccataaatactctttaaaaaatctttaagagttttaaccaggaaccagaaaagtctgaaaagtcctagggccagatgcactcatctctaaggtgacacctacgttctgtctctggataatgattacagagtccagatgagtgtccagcacacagtgagggcttcaaaggtactagctgccactttatcatctgtccttgcccattctaacagatggtgtatctgtgatgtctcagggacaaacttcacgtacctgtaaacttttctgcttggtctttgcctcccgctctcttctgctgtttccaatattctgttaaattcaaatacatgaattcttagtttcagggtttgaaattttcagttctccatttttcaatgtatgatcaatatgattgatttttaaattccagttttctgttgaaatttaaattttgtcatccatatttgaacataccaattataattacttcattgtccatgtctgataactccaatattgaagggttgtgggtatttttctttgtgtttttattctcttgacctgttctgatatggacaggaggcaaggaaataccgggtacaagagggcagttccccagcaaaggccccaccctcaagtctggaaacccacagccttaaatagaacatgcattcccgttttggtgcccaaatgttgccttttccaagagcactctggcctgccatgcccctatcctgtacccatgtaaaccccaaaccccaggctccacaagcagaagagtggaagagcacaagagcagcagaatgacacagcatggaaggagaaaagagaaggagtggccatcccacagccaatctcctctccaaccatccctggaggagttggaggagttcggctggggatggttggagaggagattggctgtgggatggccagactccagggaaagatcatcttcccactccatcccctttccagctccccagcctttctgctgagagccacctccatcactcaataaaacacccgcattcaccacccttcaagtccgtgtgtgacctgattcttcctggacctcaaacaaggacccaggtaccaagaccacagagtgtaaaaggctgtcaccctgactctccactcagctggtttaacactttaaactgttaaactgtttaaactgtttgttaaactgttaaactgtttaaactgttggttaaactgttaaactggtaaaactgtttgtttaactgttaaactggttaaactgtttgttaaactgttaaactggttaaactgtttgttaaactgttgaacaactgttaaactgttaaactggtttaatagttgctggcaactgctaaaagagtattaattgtaactcacccttaaacactaccctggggatgaagccaaaaagcacttgccccggctcctgcacttgcctgtctgcgggctccccctcctgaaaggggtttcagctctccgaggctaagccatgacccctcacaagtcccgtgagggggccagggaactctcctgtttcatttattaataagtctggtaattgaattaaatgtcgggcattgttattgaaaaagtttatgggctctacatgatgttatccccctccctagaagattcatcctgtcttctggcaggctgctagtgtagggacaatcacattcatccaatcagagacttagctgacatagggatgcttcagactttataaagcttcatctatctatgatttttttttcctcccaagctgcagctctccaggacccccaactgtgagtctggggtgctttttgagggtcccattttgggtgacttctgaattcagtattttgccatgcaatgccatgagatggcagataaatctgttgagacttaagtgctatctgctgaggttcttagtggcatgtcctctgtagattaagtgtgaacaaacgcctccagaaagaaaaccaccccatatggatctcacttctgtctctccttcttcttcctaagatctttacttcttaggcactgactggtttggaagtctgagttccaaattttgtttccctagtcccatgaaattttctgaagagctgatgtcttcgctgcttcttagcaggtgttttgcatataaaattatgtcctctcaccagagaagtttaggattctgcatattccctaagggaaaaagcagcacaagattgtaggattttagccccataacctttggcaaattatttaaattgtatgtgctctagttccctcatacataaaataaagataaaacctacttcattgtattatgaggaggattagctcaatgcgtttaaagcactaaaaacaatggcaggacaaatactctataacttttgcccttattaagcacagaaagtactccaagacacattgtgagatgaaaaaatgctgggtccacacaccatttgctactcaccattgatatacaaagaggagtttggaatgatgtatatgcttgaacaccagtgatatacctctggaaatgtctctaagagcccaatggaaaagaaaggtggcctttggggtaaagttctggatagttcagcaaggtggtgagaagaatccattgcttgcatagttttgaaaccttggaattttataccaagtgtgtatgtatcacctattccttttaaaaatctttgttaaaggaaagaacagaaaagaaaaagaaatagcaggctttggagttatgcagtcctgaatttgtgacccttctctaccatgtaggtaaagcaatataatgaggggcctcctgaaaaaggaatatgtagagtcctttgtcagaaaagcagcaaaagctgactttcctttcttattcagtctctcttttgacctctcacaatttttgtagttgcaatttaatgtggtgctgcctcagttaaggggacatgcatagggtgagtggagatcctcccaggtgtccagagccctgccctgtggcttggcattcccacccttcccctccctgcacccacactcaggccctctcctgtgggcgaagtgcagcagcagtcgctggggtggcagagggaagggcaatctgagagggtgggtgggtgattgggcagcagagaacctgtcccagtgaggccaggaggtggtgggagctggaccacatgacagctgaggctcaagaacctcagcaaacactgcattgtttaatcagacctcacctaccaagcacaaattcaaggaaaaaaaacagttaagaatttcaagacagccacactaaacctcaagcctaaggacccattctgagcatggagccctgtgggactatcttggttgcagtcctatgaagctagccctggtaccacatcctacctgtgtgccatgatttacttatctgtggcttcagtttcctcatgagtaatgtggatattgaaaaaaaaagaaaaagaaaaagaaaaaaacctcacactttttttctaagacttaaataagatattgatagcgacaggaggcagccaaatgcctaggcagataggggtgggtccccagtgaaaccccaccttcaagccaaacacatcctgaaggctgaaagaccagactgctgtcgcatatgaaacatgcaaccagagagagaacttctgttcctgttcgctggccttttccgattgattgttgctgaattatgccttttaaccaatcgaatgttgccttttccaatactaccccatctgagtccgtaaaagccctggactcagccatattaaggggactttcctgcctgtggatacggggttcacccctgcataccctctctgctgaaagctgtttcatcactcagtaaaactccccaccttactcactcttcaattgtcagcgcatcctcattcttcttgggcaccagacaagaactcaggaactagtgcacaagccagactcggcctgggtgggccatctcctgccacaggtggcctggctgagctaggcccaggtcaggtcccactggccgaagctacccagcttgcaaagtgactgagaagaaaatcttgtgtcaatattaatgctaagtacttagcaaagtatctggcatggtgtaagtctttacatgttaagtaaaatcattgtaaaccaaaaataaaattctaagcaccccccaccaaaatatctgaatggacttcctcctaggccagagcactcttaaaatttaacttgaaagactagttcaggccatgacaggaagtagggttcagacaggcttcattatacctctctggcattcacatcaacacagaccttaagtctgataagaagtatttgcaatctattctctctgaggcctgctacctgaagccttcctctgcacaataagaactttggtatccaccttaacccagacatttcctttctactgatcccagatctttagataaactcaaccaattgtcaaccagaaaatttttaaatctacctgtaacctggaagccccctccccctagttcaaattgtcccacctttctggattgaaccaatgtatttcttaaatgtatttgactgaagtgtcatgtctccctaaaacgtataaaaccaagctgcatcctgaccaccttgagcacatgttcttaggacctcttgagggctgtttcatgggccatggtcactcatatttggctcagaataaatctcttcaaatattttacagagtctgactctttttgtcaacaataatttggcgcctgaacacgtggggcctcagaggagaagcctcaggatcccaaaatagcagtagcccaaactcggagctaaggtaccagcaagggcccattgaaagcctcccagactttgagcttcccttcagatggaactggtaagtccttctgagccttggacctccctttggttgatggtccttcatttattctaagctggatttttttctcctaggaaggtggttgtttagaacccaaattcttgtttggaggttcatcctaaatggtcttctccattgcttgtatctccccaaattaatcttgatttgacttgtgtgcacatttgcgtcaggaactgagctgccatttttgtaaatgagagactgagttttctcagttctgaagagaatgggcattttgttcctcccagccaaaggtgcccctgggtgactgggggccaactgggagtgtctggggtgttgaacccctgatcccacatacagcagccctataaggagctctcaacaaaattagcttaaaaaggcccctccaggaagcacatataggagatggcctttgctgtgctttgagccctcccagaggtgctaggcctccagaaagggaaactgagacacataagagactgggaatgactcagtggtgacacactgtgacgtcccacttgcaaccagcacactttgatccactccactaaaacccgaggccatggctcagttcctcctttttttttggagacagagtctcactctgttgcccaggctggagggcagtggcatgatcttggctaactgcaacctctgcctcccgggttcaagtgattctcctgcctcagcctcccaagtagctgggattacaagtgcgtgccaccacatccaactaatttttgtatttttaatagagacaggttttcaccatgttggccaggctggtcttgaactcctgaactcaggcaatccacctccctcagcctcccaaagtgctgggattacaggcgtgagccgcagctcccagccagttcctccttttaaagaaaaaaaggtgggaaataaccctctttcaggcactccattggttttatggtgcctccacttgtgagagtttgtgtaaaatggaaatattatggtctttttgtgaacaattacatcaaagaaaaagagctctaaggttgacctgcaaactatagagttcctaacttctctttttctctattttcttttctgcctgctttagatctgctgttgcttttctactgaaatgaaaaaacactgtttggctccaactgggttttttttctgtgtgtgtgttttttgtttgtttgttttgcaagccagtaaatttgtattaatagctagaattctgaagtaaaagctataggatctttgtgtgtgtgtatgtgtgtgtgtacatatatatatatatatttaaaaggactttatgttttttatttgttttctttcctatgaccttgttcttcttgagagagtttttcttaatttctaacaacctgggatcctttaaaggaactagagaaggcatcagactcctttttggggagaaacctctgtttttccttatgaaatcccaagagtataaacagacaagtttcccttcagatattaaacttcttgtttgtgttgtgttaccttttttcaactaaaatagttactaaaacagaggctactcttggatgcttaaaataagaaagagtgtagtttagacacttagagaaatgtctttgttaaaaaaaaaacaaaaacctgcacgttgtgcacatgtaccctaaaacttaaagtataataataataaaattaaaaaaaaaaggtgcactgtaaaagcatggactagcctcattataattctcttttaggaggcccaggatacagtgtggactctccccagagctcggaggtccaattaaaaggtggagaataaaattagaactacctatctaaataaaatgtctctccttacacaatcttatgataaatttctatacttttatgcttaacttgcaatgaaatttgctttatttccctctagcataccaggctttttctctctgtgctttgagatgtcaattttgctatctgatttttcacctaagagctgtttcttttaatatgcaaatttagggctattcagctgacaactgcttagggtaaggaaacaggttatcaagaatttaggtcaggcgtggtggctcatgcctgacctcccaacactttgggaggctgaggcaggcagatcacctgaagtcagaagtttgagaacagcctggccaacatgatgaaaccccatctctactaaaaatacaaaaattagccgggtgtgttggtccacacatgcctgtaatcctatctccttgggagactgaggcacgataattgcttaaacctgagtggtagacgttgcagtgagccgagctcgcacccctgcactctagcctgggccacagagcaagattctgtcgcaaaaaaaaataaaaagacttccgaagtctaataaaatgtacttctattggcatgcctaatatgtatttgtgttgtgtgtatatttcactactaaaaatatataaagtgctctaattaattggcttaaacattttttaatcagaaaattttttataagaaaaaatagagactttaagtcaaatgttttttcctttttttttttttttttttttttgagacgagtctcgctctgtcgcccaggctggagtgtagtggcacgatcttggctcactgcaacctccgcctcccgggttcaagcaattctctgcctcagcctcctgaatgactgggattacaggcgcccaccaccatgcctgggtaatttttttgtatttttagtagaaatggggtttcaccatcttggccaggctggtcttgaactcctgcccttgtgatccacccacctcggcctcccaaagtgctgggattagaggcgtgagccaccgcgcccagcccagtcaaatgcttttttaagctcacatgacttaacaaataaactggctttaaaattattggtaaaataatatttaaaatgtcttaagaattgttggcatttttgtttgcatgtattaatcaaaaggtttcatatttattcctgcagaatacctaaagtgtcaagatttgccataaggattataaaactataaacccagcccaaaacagaaggatcttacttgtgtaatttttgataaataagacatgtaatatagttggtttaatgaaaacagctaaatcctgagttattggtaaaaaaaaaaaatttatatttaaccataattttccttatttttagataaacacatgaaattcataggtaataaaaatggttaacaaagaattcactttaaatgatgactatcacagttttcataaataatctaggtaaactattaatcaggtaaatgtaatggaataaatgcttgtaaacaaacttgtcatataatttagaatctaaggttatattatagtagatattagttaaatgtctaggtaatttccaatttaaaaattatcagaaattttttaaaaaatgtattcttattaaaaggtgaatctttttacctaattcagagttacttaaagctgaagtataaaacaaggtaaaaggcatcagtaaattagaactgtgaattatagctataaagaggtattttgggtaagaaaggtaaaaaggaaaataattttacatgagaaataatcctgtaaggtgaaattttgtcctaaaataaaatgactgggtttttcaatgaagagggatatttaggacaaaacaaaaagttcaaatatgtcttgaatgatctaagtcataataaggtcattaaaaaaagagaatttataaaaatgttatgtgattaattggctttaatgaaggaaaattgtaataaagtttttctaaaattaaactttgatattaaaaatacactaatacaaaactaaataattggttaaaacaagattttatttaaaatgttgacttatgcttaaagcaaaatttttaatttttgaattctataatctgtctgaaatttttcagattgatatctaagaaggtcacctctttcttttaaaaaggacttggatgataactttcaccttttattggcacctataacttttaaaatctaaagtaaaggagagttttttttaataggtaaattaaatatattttggatctgcctttttaaattctgtatgcctgttatatctctatctttatatgtgtcatgtgaaagtgatacttcactaccaaactatatgaaagagctctaatcaagtaacttacaaaaaaagtgagtattcactagactggtagaaactagctcagatgccttttaattcacatcactttgataatctttggtaaaattaatttggtaaatttaatctcaaaactctctccagtgatttaaaatcttaaagttatgttgtgttaaattaagtaatctcagggtttttttttttttcaactgagagtttaggttactaaaagttaaaattgtagggtcataaaaatgtttttggtgaagtttataaaacacaaggatatggattttgctaaagaaagtgtaggtcggtggctcacacctgtaatcccagcactttgggaggccgagatgggcagatcacgaggtcgagagatcgacaccatcctggccaacatggtgaaactctgtctctactaagaatacaaaaattagctgggcgtggtggcccacgtctgtagtcccagctactcgggaggctgagacaggagaatcgcttgaacccgggaggtggaggttgcagtgagccgagaccacgccactgcactccagcctggcacagagtgagactccctctcaaaaaagtaaaaataaaaataaataaataaaatgtagggtttttttctagttaagaaactatttaagagttgctttaaaataaatgaaaaattatacagataaaagtaaatggataaaaggaaaaattaagccagagcaacaaaagttaattctgagacctttgattaccaaaatgatagtcaatgtaggggaagggcaaaaccaagtaactatactaaagggtataatgtaaaaccagagggtataatgtaaaggaattgttccattttgtagattggtatcatcagcttcttgagaaacctttactataatagatggtaaaaataaccatcttaaggacacaatccttaattttaaatgctacagaaaataaaagcttgtttgggctgacccagaacccacagctcactattgaaccatcactaatgagtatatgtgatttcaatgcacaggaggagagaacaaccagcctagtggactggataaatgacactgtaagctctgtttgccctgagaggggactacccagctctccctataaaataccaagtggagaaccccagatgaagcagttagtatgcttcatatgcaagccatgtgggaccagctttatgataactgggatatcctcctaccaaatgtgcctattaccctggtcatggtaaatttgggggttaagtggggagcccttttacatgggtgcccctcctgcagaatcatacaactgtctgagaagccttatcaagtttactgtacctcatgggttttacagatgcaactccctgctgggaacacaaatcctttttcactagaaaaagtaaaatgatctggggatagtaaaacaagttcctgggatcagaacacaaaaacatacaggttaatagaattatgaaatttaagatgtttacacaggctttatgtaaagtagttgtaacccctttacctaaatgtcttacgaaaataagtattgtatctaactgggggatttttcccctatctagtactataaaactgaagacatgtacatctgctctttgagaactgttgcttggactcactaaatgaaaagtagtatgattccctgagcccacaaaatatagcctaaagggtggagtgctagttgagacaaatcctccactttatagccctttatgaagtatttattggggcttaatgcaacaaggctgtactttccaatgacaaagactgaactagagaatttccacttgaggaacatttactgccttgctatgaaatgttaactgaagctacccctatgctgaatgaaaataatggtgccccaaagagtaaaataaaaaatggtttacatagaatcttgctacctggggatacaaggaggagaaacttataagcagagagcttcttttttccctaggactaattctcactatgtgaggatctgctagattctacagtgcctgatagacagctcccatgagttatttggtttgcgaatggcatttccaaggtgaacaaacatcttgtttgaaagctgctgctctggttaaagaaggataaaaaaaaaatcgttttcttttgagttatttgggtgaagtatgtttttgtaagcaaatttacctttctctgtacctgagttctccagaattcgggttgtgatttcatgacaatatagttacttgcataaatttagtaatagtcttttaaaacaaaacaattggagacactggttattttaccaagactttaactaaaatagcatattttaggtaaagttccagcaaagccaacttaaaaggagcttatatggccaatcaattcttgttacattttatgcaaataatcaggccaagtataataagcctaaaacctagttcgcacacaaattggtcttactataatttctctttaatagaaaaggagggctagagtaaaagaaattgtttccaaggaaaagcgtaacacttgatactagatttcagccctaacttttctttttttaagtgcagattgaatcatgaattatttcttggctacaataatcctctacagagtactagattataatttttcttcatatctttagttggtgccctaatggaataggttcctttttctgttcaaacacacaaaaattctttgattgtcaaaacattaatgttattatctctccttgttttacttccaaggaaacccaaatcatggttttctgaagaccagagatgcaaatctccctcatttggcatcccactgggtctgatctgtttttcactgcaaatgccctactgctaaaacgatgcaagcaccatccccccaggcccagggatcgtcacagaagacgtgggtgtgagagatagtaagggctggttttgaggaataaaattaggtcaagatcagaccctccaaagcaaggatagatacaaagatgcctaaagagctggtaaaacaagggactttgtcttctaagctattatgtgtcacttttgcatccaccccaaccataaagcattttttgctccctgtagaattaaaagaaaatatctgtgacacaagaaagataccttgtgataaagcttcctggatataatactcccagttatgagttgagaagataaatatattaaaactttttttttcagagcagtgcttatgatttgtatagctaattgctacaaatctgtaactaaatccaaacttatagtaggtcaacgcataaaagttacagtcagttttgtaaccttgcctttggtttttgtttgttggctttttacctaaaataataataattttaagagataataaatacctgtccacgttcatcctatctggcctataacaattaattggctgtaagtctttttactcttaaggtccttggccatagggacttccaccgagggacaggatggacccagggagggcagccctgccaccccagcaacgctatgagagaaaataaaaatttactggctaaataaataaataaacaaataaatttactggctattgatgttgcctctggcaaatcttgtcaagaaggaggagaatgtaaaccaaaaataaaattctaagcaccacccccaaaacatctgaacggacttcctcctaggccagggcacacttaaaatttaacctgagggactggttcaggccatgatgggaagtgcggttcagacgtgcctcattgtacctctctggcattcacatcaacacagaccttaagtctgataaacatttacaatcttttctctctgaagccttcctctgcacaataagaactttggtgtccacagttctttatcttaacccagacatttcctttctattgatcccaggtctttagattaaactcaaccaattgtcaaccagaaaatttttaaatctacctgtaacctggaagccccctcccgctagttcaaattgtcccacctttctggaccgaaccaatgtatttcttaaatgtatttgactgaagtgtcatgtctccctaaaatgtataaaaccaagctgcatcctgaccaccttgggctcatgttcttaggacttcctgagggctgtgtcatgggccatggtcactcatatttggctcagaataaatctctccaaatattttacagagtctgcctctcttcattgacactattaaattattaatgagactatgattggtattacttgatcagttaacaacttgtgaatgctacatatgaaatataaactatgaaataccttatgaaatagtgtaaagttgatatcatcaacacatggcaacatcacaagagacagaatcatggaacaccagattaaacagggctattctttctttagtaggagaggaattgtctcatccatccataaagtccaactaggccacccacctgcagatcatctcagtcagttcacaacaaagtacctgaccgttatgaatccaactgggaagaagttggtcccggtgaggcacctgtggttcctagaagcagggtcatggccctgagtccccaaggcaaccaatatatcagggagatctgtctcccttaggaaatgcagggtgaggttttccctaagggtcaggcttggaagttggttggaagagttggtgcctatcttctgggtattgtccagtttgcaccagaaacacaccctgtcttcaaactaagaacacctgttggtgtgccattttcatgcttccatgggacaggagtgttcataggtttagacttctttcctgtcctcagcccaggacaccagcctctttgcctctacctgctctgccttccttatgggtttgggtagctcttcttttcattcaccatagtgccatcatccctgtccatgctctgctcatccgagatactccagggtatgttcccttcctcgcattccatttatagggtggtggggtgggggggtggtagccagagggggtgtggaggttaacaggggagagatcataacatgtttgtggagtgatagggatgattcatatatagtgtaggccagtgattcagtgtcagttttctccatggtaatgagccagttctccaaatgttaatgttttaaagacacagtgttgggagaggaaatctgctgggagccctgagcattcctttatgcttttgcggagtacaccaataattcaaagtcccccactctttacctgggagatttctcagagttctcttttagtgagcaacaaacagggatgcttgagggatgaggtaacaccccccacagagagcatgattgctcccactcccaagaaagacataggatctcccaagctcagtgttcctctcttgtaacacaattctcagcaagtgtgagcatccacgcaagtccaccttcatcacccccgtggggcttggagggcatacagagccagtgcaaacaggaggctctggcaactacttttgttgaaaggaataaagtcctttgcctctgacccagagggtttctgtcttctgccagaatgtcaatctgtggcaaatgaacttgtaaacttgcaagtaggttaaaatcataggccctctaccattcttgacacatagatttaaacttatcagtactaaacctcatcagagtgcgcaagttctctgcttccctttgcaatttgcatcaaagtcaactccactaatatggtcttcatggtcttccaggccctgcatagcctggccctgcctacctctccaggatcttgtgccagttgtgtccaaatctctctgcttttgagtcatatggggaaaaatttgtccctgacatctgggcactggtatgacacttacaattaagcttccatgttgctagtagcatggcctcttgccgatggctagaccatgttgttctccagatagacataaataccagaatcacccaatcaaatcccaaatcccataacagattctttctatcatgatctttctgaaacaccattgttcttcctgacatgcattgtcctttattgccatgaatagtaaacccaacttatttaactacttgtgcattcctggcactctttggctggaggacattggcatatacacatgctgatcttcttccagtttatcaacattccattttctttcctgccacaggcactttgcacatactattccttctgcctagaacattgttctcttcacctccttgaccttgctagcccctccccatcttgaagttctcagcataaatatcactttctttaggatgttttcccaactccttcggcaaaatctgggtgtattctctgatagtgtgttaggtttttcccattatatacacttttctaatttgtaatatacatttgtttgtgttactgtttatttatttaatatctttaagggtagataccagtcttctttgcttattgctatagcccagcatctattaggaggcctagtacattgtgggcactcagtattcatcatttctttattctacaaataattattgcattgatctaggatccaaagttaaaactgtccaagtcctggtcctcatggagattccattttagtcagaaaagataacataagaaatgactaagtcccttaacaaatatttattgagcaactcctagaaactgcacattgttctggaaggtagggatgcggcagagaacaaacctgatacaatttgtattctctcagactttacattttgttttacatatgttcatgttagtgtatatttatatattaatagatctatatgaggtttagtactgataagatttcgtgtaaaataaacatggtatggtgatagagaattagagtgggtgccatttttggtatgatagtcaaggtctctctgaaaagttgatatatgacctgtggaaaaatagaaaatgccgtcatttgatcatgtgagcccttgatgttcattgtagtaagttttttatctgagcaaggtggagagccattggagattgttgagcaaagtaggaaattaacttacatttgaacaggatttctctggctgttgtgaggagtactgactcaagagtggaaggtgagggactacagtgatagggaaattaggtaaaaggctactcaattactcaaatgagaaatgatggtggcttagatcatgatgctgcggcacatatggagatgcacctctggaatcctttaaagtgggacttgccatccaactgagaaaagtgtggttagctgacaaattccacttgttagctacttcaggatcttcaaatacttcaaattttgaaattttgtatgtgcgcagtgtctcatgcctgtaattctaacactttgggaggcagagatgggaggatagcttggtttaggagctcaagaccagcctgggcaacatagcaggaactcgtctctacaaaaaaattttttttaattagccaggcatgatggcatgaacctgtggtcctagctactcaggaggctgagatggaaggatcacttggggccagaaagttgaggctgcagtgagccatgatcatgccactgcactccagctgggtgacagcgaaaccctgcctcaaaattgaattttttatcttttcctgggctagtgatatgcagtatgatactctcccatgttgctgggcagtggcaatgagccacagttcccagccagccaaataatcccaatggtaaacaaataatactatacagtgtactgtattcaacaaacttatatgaaatatccaccaccttattatagaatatgtattatgttagattattttggccaactttatgctaatgtaagtgttctgagtgcacttagggtagactgggctaagctgtgatgctcagtaggttaggtatattatatgcattttttacttataatatttttaaattacactgagcttatctagatgtaaacccatggtaagttgaggagcatctgtaataaatctctttatatatctcatattggttcagtttctctgaaaaactctgactaatacagtcccaaataaaattttgacactcctaactctgtctcattatctgcatcccaatgaacccagtctgtgacagaggttaatagaggataggagaagtgtacagattcaggatacatttgaagatagagctgacagaatgtgctgatgaatcagatatgccatgtaagacaaatatttattaaatgtttcttaaacaaatatgtgatagatattaccactcttcaccaattttgaatctgggaaattctgcacaaaggggaatgtcacattttcttgtcctcttgaagttagaggtagcaatgttcttttctctggtaaatgaaatatgaatgaaattttaaaaatggtcacttccttttgggagcaattaagaattgttgagtgtttctccatgctttcttctccctactcctataactggtaaagttcagagagtatagtctccatcattatgagtgcctgaatgagctcaatgtggatcacataccccttctgattcatgataaacaagtacagtgaacaagaaacaaacattggtgtgttaagctactgaacaagaaaatgttatgttttattacaagggcctaatctagcttaacctgactgaaatagctgttggtgctggaagtgaagtgctacagagacaaaacccataagaacctaaatgacattgactaagcagtcgggtggtgaggaaaaattcattgagaattcagagatattaagaacattgtttatgttcacacatctggtaaatgggagaggtgaatttgaatgcaactctacttgactctaaagtctacgtcatttgtcgctatagcctctcagttttggcttatgtggttggatagtggtaatctgtctttaactgatacatttattctttcaataaatattatttgtagtaatattgactatgttctaggcactgtgctagacaggcagaggaacatataaatcagtaagtgaatttttagtcatgttgagttttacctgacttcgggactgctggatggagagaatggtccagtaaaaattaattaattaattaatgtgacgaatgtgtcaagcatttatacagtttgtgttactgctggggctggagtggtgagaaaatccctcttaatcatggtttctaattctttttatacatctttgggttctatttttaatattttgttgggtttttaaaaaacatctaggttcattcaaaataatggtctggctgggcacggtggctcacacctgtaatctcagcactctgggagactgaagccggaggattacttgagcccaggagtttgagaccagcctggttaacatagcaaaaccctgtctctccaaaaatacaaaaaattagccaggcatggtggtgtgctcctgtggttccagctatttgagagcctaaggcaggaagatctgttaagcctgggagatggaaactgcagtgagccgtgattgtgccactgcagtccagcctgggtgacagagtgaaaccctgtctcaaataataataataataataataacctgtagttttccccttttgtactgcttttgtttggttttggaattaggataatacttaaatcataaaatgatcaggaagtgttgcctcctcttttattttctagaaaagattgtgtatattggttttaattattctttaaacgtttggtagacttctccagttaaaccatcttcgcatggagactcctttttctgaagctttcaatttaaaaattcaatatctttcatggttataggattgtcagattatgtattttatcttggttgggttttggtaagttgtgattttttgaggaatgtgtctttttcttctatgccatcaaacgaatgaacataaagttgtccatactattacttattatctttttaattatgtaagctctacagtggtatcccatttcattcccgatattggtgatttgtgcttttttattttgtttttctatcaagaggtttattaattgtactggcttttttgtcatagaacttccttttggtgatgtttgcagtgtatatctttttccatgctttcactttaatctacctatgtcatttaatttgaattgagtttcttgtaaatggtagcctatcttctcaaaagttcctgagaccgttttatttgtttttggccaatttccgtgttcagattagataaattctattgatatgtcctcacttcaccaagtctatcctctgtcttctccactagagcttatccaggaagtgttttcttaactcagatattatattatttctgactgagagtttctgttttttcatttgtttcaagagaatttcaaatttcttgttgaagtatttttatgatggcacctttaaaaatccttgtctagggtgtcccagccctggaaatgaataggcatctgggtggagctgcttgttgtggtgggaatatgctggatcctgctacactgttgcagcctatctctggtgataaaggatagcccaacagagaagaaaagacagcactttccctggccatttactgtcagcagatccccctggccattgctatctagctctgttggtattgatgatggcacttaagttcaattcagggaagaaatgagcctgcctgggctttctgttgtagctaggttggtgtctgggaaatgtcaagcctgggttgccttattctgttaagttgggggagtcatgagacaccctactcctacaggttgctcccacagccctgggatcccttactagtttgccttcttctttctacctttcagagatcttttttgattgcttcttgcattcgtcacatagtatatagttgtacttagcagtaaggagcagggaaaaaagtgagtccacggactggatgttcactcatagcatttttatcattttgtcattttgatttatctctattattttggggtgtatttctttgtatagattttttagttgttgctttagatattacattatgtattatacatattattgcattatacatacatttcttattatagtttacccatgtcctcatttcaccagttcaagtgaagtgtagaaaactttctaggctttaattccctttgcctcccctatttatgatacaatcatcttaaacattaatatttttctaaatactttatgaaccatacaagacaatgctataacttgtacttcaattgtcaaacataatatggaaaactaaagagaagaaaagtgggttgtattaacccctaattttgctcttttcattgttctttcttccttcctgatgttccaagatttcttcctttatcattcttttctgtttatgttctctaaccattcattcagggcagatctatttgtgacaaattctcttagtttctttaagtctcagactatcttggtttcctcttcttttctgaaagatgttttcactggatatagatttccagattaatagctcatttcttgtagcactggaaaaaggctttgtcacttccttctagacatcatgatttctgatgaaaaatccactgtcaacctaattgcttcctctttgtagataatgcatcacttctcccttgctgctttcaggaattttccccccaaatttgaaaatttttctactagtatttcttcaaacatgcttccagctcccactctctttcttgctttctgtgaggctatgatggcaggaatattaggtcttttgtaatagtccatcaagtacctgaggttctgttctttttttcccagtatacgttctctctttgttcatattaggtaatttttattattctatttcaagttcactgattcaatcttctgtcttctctagtctgcttttgagtccatccagtgattttttaaaattttggttttcatatttttagttctaaaatgtatctttgagttttctttatgtcttctatttctttgctgagactttctattttttatttgtttcaagcgtgtttgtaaatgcacattgaaacctttttatgatggctgctttaaaatacttgtccaataatgccaacatctgtgtcatctcagtgtttttttctttttgggacggagcctcgccctgttgcccaggctggaatgcaatggcgtgatctcagctcaccgcaacctccgattcctgggttcaagcaattctcctgcctcagccttgcgagcagctgggattacaggtggctgccactacgtccggctaatttttgtatctttagtagaggtggggtttcaccatgttggccaggctggtctcgagctcctgacctcatgatcagcctgcctcggcctcccaaagtgctgggattacaggcgtgagcctcggtgttttttatgttatgagactctggatattatttaaatcttttgtttcagcagatcttctctgataccatatcagtggggaaaggaggagtgttgccctataactgctaggtgagtatggaagtccagattccccacttagcctcccttggtacccagagaaggaggggttcctcattactactgggaaaagggtaggaatccccaccaggccaacactgaattactctgtctctgtgttgtagggggtacctcattactgtttccaatatggcctctactgaaaccatgggggaatgcctccttattaccaggtggggatgaatgtcacagcctcccattcatcctcctctgaaaccaccccaatgagggagaagtagtgctttgttataaccaggtgagaatgcaagtctaagctcccaacttggtctttgttagtccagaggtggagtaaggccacattctttgccatgaaatttggctggagtagggtggttattttctaaagttttctatattgttatgctgatcctttcctggtcctttggctagaaagacaaggctcttcttgggcttttttttttctgtgcccttagcatttctgggtttctagattctgcagtacccagacttggatatgtaaggcaaaaggaaaatgaacagtctcacttctgtgttgcacctcatgttctgaagttcctagctggtcaggtttcttctctctatgtttcaaaaccttcttatataggttttatatactatgtaagggtttttagctatatttagtgggaagaatagggagaagtgcatcttctccattttgttctagaaccaaaacctgactggcaattctaaatgagaattttagtttgcaaatgggctaacgatttgcatctttgcattcacatgttctcttcctgtctgcctaggaaaacaaattttattaagaagcttccttggtgagcaaataagagtcagagacaagtgattcttactagttatgtcaaggagcctaacatgtttatcactgctaccaaaaggaatttaatgttcaatttttattttcatgcaccatttttctggggtctataataacagcccattcctcctttctttactagtttttcttcagtctgtgcccaatgtagttcattaggtttcaaatttcttggattctatcctacccctttgatgtttcattcttgtcattcatatagacctcgatattgttaaattgcctcagatacaaatttgcatatatagtgtacatggtagccaatggtatatcacacaagagcatttggtatctgaataatccttgataaaattgttaaagtgaagtgaacatacgttatgggtgttataaagtgacttgatacgtttaacaagagataggattcagttatctaacattcttgtgatcagtaatattaaaaatattgtagcacactaaagacataaaaaggtataaagaatggtgcaatgcagtcccatgtactcaccatccagcttaagaaattaaactacattaaactatattaatgcttgtttttgtattctttgaaacattattacggctctgcaaattttgaggacaaagtaaagactgtaggcgttgatgtcagatcgaggttctagtccaaagtttactatttattagttaattgaccttaagcaagtcatttaacctcttagaaactatgtttcctcatctgtaaaagagtagggatagtgcctgtttcacaaggtagttgtgatagttaaatgagataattttgttattaaggtgcctcatcacagtgcctgacacccaataaatgcagtttctattgtcattttgtgtcatcctaagtatgcaggggaaacaaaagtaagcctttattcttgtcttcaaggagtttgtcaaaaagtaagaaggataaagtaggcatacaaatagctactataagatgtataataacataaattccattatcaaaatgctgtgagagttcaaaggtttggaacatgctgagatctggagatgtagctttttttttttttttttttttgagatggagttttttgctcttgttgcccaggctggagtgcaatggtgtgatctcggctcatcgcaacttccgcctcccgggtttaagcaattctcctgcctcagcctcctgagtagctgggactacaggcatgcacaaccacacccggctaattttgtatttttagtagagacggggtttccccatgctagtcatggctggtcttgaactcccaacctcgggtcatccacctgacttggcctcccaaagtgctgggattacaggcgtgagccactgcgcctggtcgagatgtagcattaaaactaggaaagcaagtatattgccatacccctcctatatccatgggcggacactactttttgatctcagatatgacctcaattttttttctcaacatattgattcagggaatcataactaatcaattggagttgtccttgaaatagagtatgtacctaaagtatgacactcctgggaggacatgaagaagaaggggacataggctgagagtgccaaatagcagaaataaaagcgatagaacggtatcaaattttaaagacagtcattgctggtgaattttgagaaacaagttatattaaattgaacctatagtaaagggcataggaattgttggggttgtgggcatcaaagaacgttgagactaaatttggatggataatccaaataaatcttgaggttatttatgataatggcagaaattgcagggggaaataagaaccagctacatggtgaggagcgatgaccaagaacatagcatagtataacaaggaagaggatttgtgtacatgttgactcccacttactagattgcggtacctgaaagtcagggaatcatacttcatcatcctggaatcctagcatctaatacagagtacaaagcattgaatatatggatgaatgaattagggaatgtgtggtgatcatcaaacgagtgtaaacaatatatttgagaacaagttgaaaataccaccctaaaagagtttatattggggttaaaaagaagtatttaaaattgagtttcctttgagtaaatcatgccctccttttcctgagattaaattggtaatttaccttattgatcactcattattatctcagtctatgtcaaagcttcttatccgtggctgcaagttagaaacacctgagtagtttaaaacatatcccaataacctggctgcaccccaggccaaatcagaatctctggggatgtgacctagtcctcagtatttttaaaagctccccagatgacttgtgctgccaagattgagaaccactgagtgacgacaagataagacagggtacaggtgtgttaacttgtataactacataaaattcagtattacagctagaattaattgtagcagtcttttttaagaaatgaaatatctcaaactcaacttctgtttacaatgtttatttaacaactacctagtactcaatatagagtttgttaactggaggactatagacaggttgagtttggttatcacagtgctgaaagttttacatcaattgccaacattttatggataaaattcagtagatttcatgtaaaattaggaacttcaaacttctcttgaaaatcagaagatttggtaacttgatatttgcattccctagaggtaccaatcaatcgaaactgagtagtagctgctagctgctgccccatttagatggaaatagtcaattttgtggggttttttatttttatttttttgagatggagtcttgctttgttgccgagactggagtgcagtggcacgatctcggctcactgcaacctccacttcccaggttcaagtgattctcttgccttaacctcctgagtaggtgggactacaggcgcgtgccaccatgcccggctaattttttgtattttttagtagagacgaggtttcatcacgttagccaggatggtctcgatctcctgacctggtgatccacccacctcggcctcccaaagtcctgggattacaggtatgagccaccgtgcgtgcctggcctgttttttttttttctttctttctttcttttttttttttttcgctctcattagaggttaatcaagtttactgatcttgcagaaccagcttttggtttcattgattttctctgttgttttttatcatttctcttacattagtttccactttgattcttattattccctttttttcctgcttactttgggattttcactttttcttaagtttctaaggatgaacatgaggtcattgatttgaaatctttcttcttttctaatgtagatattcattgctattaatttcctcctaagtacttctttaacagcatcccacaaattctaatatagtgcattttcatcttccattaggctaaaaatactttttttttttttttcagaccagagtcttgctctgttgccaggctggagtgcagtggcacgattttgcctcactgcaacctacgcctccctggttcaagcgattcccctgcctcagcctcccgagtagctgccaccatgcccagctaattttttctattttagtagagacgaggtttcaccattttggccaggatggtcttgatctcctgacctcgtgatccgcctgccttggcctcccaaagtgctgggattacaggcatgaaccaccgtgcccagcttaaaaatactttttaatttcccttttcatttaatcctatgatacatgagttatttataagtttgttatttagtttccaaatgtttagggattttccagagtttatgcactattgatttcttagttaattccattgttatctaaaaatatactttgtatggcttgaatcctttaaaatttacagggagatgttttattccacagaatatggtctattttggtaaatgttccatatgtatttgagaagaatgtacattctattgttgattagagtgttctataaatgtcagtaaggtctagttggttgattgtgttgttcaaatctgctttatatcattttgacttttctgcttacattgagagaagaatattaaaatcccttactgtatttgtggatttgaatatttctctttgcagttctatcagggtttgctccatgtatttcttttattaagtacataagcatgtatgattattatgtctgcttatgtaattgactaagttataactttttttttttttttgagacgaagtcttgctcttgtcccccaggctggagtgcaatgacgcgatctcagctcactgcaacttctacctcccgggttcaagcgattctcctgcctcagcctcctgagtagctgggattacaggtgcctgccaccatgcccagttaatttttgtatttttagtagagatggggtttcaccatgttggcccggttggtctcgaactcctgacctcaggtgatccgcacgcctcggcctcccaaagtgctgggattacaggtgtgagccactgtgcccggccagttataactattaaatatccttctttatccatgtaatattcttggctctaaaatgtactctgtctcctccaaatttagcctctctggctttctttgcactaaagttaacgtggcatatctttgtcacatcttttagttttattatatttgtggctttaaaactaacgtgcaatagatagcatatagttgtgtcttacatttttattcagtctgccaatctctgactttaaattggggtgttcagacctgttacatttaatgtcatttattactatgatttggtttgagtctagtatttttttatttgtcccacctgctctttgttcccttttccctgttttctgtcttcttttgattagtcaagcattttttctttctttctttcttttttctgagacggagtttagctcttgttgcccagcctggagtgcaacggcaccatctcagctcaccgcaacctctgctccaaggttcaagcgattctcctgcctcagcctcccgagtagcttggatcacagacatgtgccaccacacatggctaatttttgtatttttagtaaagacgggggtttccccatgttggtcaggctggtctcgaactcctgacctcgtgatccgcctgcctcggcctccgcaagtgctgagattacaagcatgagccaccgcgcctggcctagtcaagcatttttctgattctattttatctcctttgtcagttcattacttgtaactttttgttttgttattgtagtgattagtcaaatttcattttaaaggctttaaataatgaggattttaaaaaatatatttatccttttcactaccatttctggccctcttaattcctttctgtagatacatatttccacctagtatcattttccttctgcatgaaagactttaacatttcttgtagtacagttctgctagtaatggattatttcaacttttctatgtctgggaaatgtctttattttaccttcgttttgaaagatcctctacagaattttactttgacattttattctttcagtatattaaaggtgtttctccattgtcttctcgtttgcattatttccaattagaaatccaatgtcggctgggcgcggtggctcatgtctgtaatcccagcactttgggaggccgaggagggtggatcccctgaggtcaggagttcgggaccagcctggtcaacatgatgaaatcccgtctctactaaaaatacaaaaattagccgggtgtggtggtgggcgcctgtaatcctgtacttgggaagctgaggcaggagaatcgcttgaacctgggagatggaggttgcagtgagcagagatcatgccactgcactccagcctgggtgacagagtgagactgtctcaaaaaaaaaaaaaaaaaaagaagagagaaattcaatgtgattgttatctatattcctcggtatataacatgcttcttatctctagctgcctctaagattttctctttttcactgattttaagcaatgtgattataatgtgcattggtgtagctttcttcatttttcttgttcttgggattcatttatcttattagttctgcagatttatagttttcatcaaatttggaaattttcagttattattgctttaatttttttctatctcctcccactctatcttttagagactccaatgacccatctattagtcagttgaagttgtcccacttttcactgatggtcttttaatttcttagaattcattttgtccctgtgttttattttggatagtttacattgctatgccgtcacgtacactacaatgttcttctgcatatctaatctgccgttaatttccatcatcatgtttttcatcttaaaaattttagttttcacttccagaatatctattttggtatttttcatatcttccatgtctctacgtaactttttgaacatatggaacatagttataatgtctacttaaatgtccttgtctgccaattctaatgtctctattagccgtggctcaatttcaattgtttgttttttctctcaatatagctcgtatttctatgctttttttcattgttcataatttttaattggatattagatagacattgtagagtgtaccttgtttggtgctgactgtttctgtagttacataaatattcttaacatagttctgaaacatagttaaggtatttagtttgacccttttggttcatacttttaaattttgttacaggactgaaatggtgttcattttaggcctaattattttccactactgaagctatccttctgtgcactctacccaatgctccatgaattttgaggttatctagtgtagctggtgagaacaccattatttttgccccttcattcaccgcagacactgttaggtctaatctttttgggtgattctctatctggtcttgggtactttcctcacatgcatgctctcatcagtcctcagttgaatgttggaggaaaatctctgtagatatctagctatctacagctctctcctctctgatcctttctcctgcaaagtctgttcacctcagtcttcctggatgctcagctccatcttcttgatgtaccataccccagaaaatatttcaaggcaaaaattgggacagtctttgggctcacctcatttcccccacccccatcattcagggctcactatccttcatttctggatttctggatctccaatgtcttggaaactgtttcctatagctgaaacatattttggttatttcagttataagggtaaatctgttacttcttattccatgttgtccataacagaacaataaataattttttaattgaggtattttatatgcaataatatgtactactcatgtgtgtatagctcaattatttctgtatctgtgcaatcaccatctggatcaagatattaacattttcaagcacccctagcaggctacctcactactctgtcttattgaaagctatcttattcttttgttttgaccttgaggaaacttatgctagaatcaggataaatctgagtaattttactgctgccacccctactatcaatctccatcttccagaagtagtcccatttcagagattcatttttttttcccaacagatggtcattacagagtgagtatttttgtccaagaatattgggcctaagtatttagatgttcccagtttaacattgaaacccaccctgatctcactgttaccagtttattattcacatagaataccaatagatgctacagaaagtaagtgatgctaatggattatgattatgactcagatcacgaaaagcagcatggtgctgtggaaaaagtaatggcttacttcctcttttccctctttcctgcctagacaagaaatcaaaaactttattttaaaatcagcgccattttttcctgaatttctgatagaattgttactcctatatagctctgttcccccttcctgatttttgtagtattatttgtatacatatcatatccatatgtattacaaacccaataatactttattatgattattactgtacatactctcgggccttgtaaagaagctgagagatgaaaggtgagcaactatatatttatggtgtttgtcacattaaccttttaatttatcatttctgactcctatttgttaatgtgaatttgaattgccacctgtgtctttactccaataagctttgctcccatcccctcccatgtgatgttattggaaattatattgtatttatgaatgttatagtcccaacaataaaattgtacgcatttttatataattgttgttaaatgagttaagagaacagagaaaaaatatagatttacatagccatttttattattatatagtttcctttaccagtatttactttgtgtgtgtggattctgtgcgctctgtgcttttaggctgaagaagtttctttattacatttattgttagatttatctaccagcaataagtgtttacagtttttaaatctgtgaatgtatttattttgccttcatgtaagttttttattttttaatcattatttttttgagacagggtctcactctgtcacccaggctgtagtgcagtggtgcaatcacagctcactgcagccttcacctcccaggctcaaacaatcctccggcctcagcatcctgagtaagtgggaccacaggcatgtgccactaaattagccactggctaatttttaagtttttcatagacatggggtctccctatgttgcccaggctggtctcaaactcctgggcttaagcggtcctcctgcattggcctcccaaaatgttaggattacagtcatgaaccaccgtggacagctgtcttcattttaaaagatagtttttctgaatgtaagattctatgttgacattttttttctttcagcactttgaatacgtcatcccactatcttgtggtctccattatttctaaagagaagtcagttggtaatattagtggggctccattgtagttgatgagttgtttttctcttcttcctttcaatattatctctgtctttggctttcagcatttttctgtgtatggttcttgcgtttatcatacttgaagtttactgaacttattggatatataatttttaaaatcacattttgtaattttatcagtcattatttctttgaatacttttttcctgctcccttttctctcctctctccttattgtacatctgttatgtgtatatttgtgggcataatggtgtgctgcctttttctggggctctgttcatttttcttcatttcttcttctctctgtgcctcagactggtgaatcttaattgatttatcttcaagtttgttgattcttccttctgcctgcccaggtctgttattgagctcctcccaggaatttttcacttacacttttcaactccaaaattttaatttttctgttttataatttctatatctttactaatattctctatttgtcaacatacctcctttccttctttaagcgtggtttcccatggttctttgtatgtatgcataaaggctgattaaacattttttctgttatatctgacatctaggccatcccaccggcaatttctgttgcctccttctaattcctgtgcatgggtcagacacttctgtttgtttgcatgtctcatcatttttttgtaaaacatattgtcttttttcatgatctgttacgctgtctgcctctgttagtatcattccctgctattaggctccactaattgccggctgatttgctctattgttttggataacacccttgggcataaattactcaacagtctgatccattaaatttgacccctttgcaggaatagtttttgaagtcaaactgaagttccttctgactctaggaggactcttgttagctgtctctttctctgatcctccctggaaaactacctggcttgtggtttattttgcttctctcatggatctaccagactgttctcaatgctcaccactaaaaacttcattgtttttgagattgtgcttgtgcttgaacttaccacactctgttccaaataaattcagttttattgcagagagctttgaagctctcttcttatggccagtctccctcctgggcaaaatcactgcaccactgctctggggcttggagtagaaacagtggactgcttctctcagagtgaaagccctactttatgagttgagcactgggtagaggcagcaccctctggtcttcttggcttgtctctgccactgtggaacctgcactctatgagcaaacttgaacgagggatattaaaactccagtatttttggcctgccattcctgacatagagtttccaccctataaatggtggctaggtagaggaagggcaccctgggcctctcagctgcactcactttgaatttagactctgcaacataaagctggaggtgatgaaaaatactaatactggtggcctgctcaccccaagggagaaataatagcccttaaccaggagactggggaagaggaggctatattttcttggccatacccacccaaatgatagctttaatcacgctgattttgatgggggagggattgagtaggtcatggctcaagtgccgcagactttcactgttcttactgacatttatattttttgaataaatgtttcttcatttgttctatgcctttagagaaattttctgagactttatatggttgttttaaaaataatttttagcagttatggttgtttccctgtgcggatggtctgtagaacacctgatacttcctttctggaagtctgtgtttttattcatacaaaagctgagattaatggatatcttcaaattaagtagagtgaaactcagtaagaaatcagtaaaagggaaggcaaaacaaaaagctgcaggataaataaatttaggttatttgcattagctgctcatatcagtagggaaaaaatagattcagtcaaaatatgtttttggaaaaagaaagtaaaccacctggaagaaaaaaatataaaatgggattttccctcatatgtcatctagaataaattcctaatggatcaaatatttaaattcaaacattgatacattagacgtaacaggagagctgttcataatcttggaggagaaaaaggttttctaagtatgcttacaagaaattcacatcagtagcctaaaagtaaaaagatggaaaggtatatcatgaaagcagtaatcaaaagaaagatagagggccaggtgcagtggctcatgtctgcaatcccagcactttaggaggctgaggagggccaatagcttgagcccaggagtttgagaccagcctggcaacatgccaaacccctgtctctaccaaaaaaaaataaaacaaattagctgggcatcatggtgcacacctgtggtcccagctactcaggaagctgaggccagaggatcacttgagcctgggagtttgaggctgcagtgagctgtgattgcaacactgcactccagtctgggcaacaaggtaagaccctgtcttcagaaaaaaaaagaaaagaaaagaaaagaaagctggagtggttatattaatatcagacaaattatactccagagcaaagataattcccaggaataaagaagggcattatataataataaaaaggttccattcaccaagaagacataaccttcctacatgtgcgtacactaacaaaagagtttcaaaatacgaggggacttcaaaaagtttgtgggaaaatataattaaaagataaaaataaaaactataaactttatttctcaacattagctccatcaagttcaaaacacttttgtaagcaaagattccagccatttagtccatatctaaagaactgaagggcctggaaatttaaccatgttaatgtaggtttttgtttgtttgtttgtttgttttttacattattaatcgaagagaaacaagcaccttttaaagatttttttaagattaggaaacaaaaagaagactgaaagagccaaatcaggactgcatggttgatgcctaatgatttcccatcaaaactctctcaaaattgcttttgtttgattagaggactgaacaggagcactgtttatgtgaagcttttctgggtgtttttctgcttaagctttggctaacttcctcaaaacactctcataataaacagatgttacttttctttagccctccagaaagtcaacaagcaaaatgcctcaagtataccaaaaaactgtttcctttacctttgctcttgaccagtctacttttcctttgactagaccactgccacctctttgtacccattactgtgattgtgctttgttttcaggatcttactggtaaagccacgtttcattttctgttataattcttcgaagaaaggcttcaggatcttgatcccacttgtgtaaaatttccattgaaagctctcctctttatctgctgccgatctgggcacaatggttttggcacccattgagtggacagttagctcaactttattttttcagtcagaattgagtaaactgaaccagttgagatgtgtatggtgttggctattgtttctgctgttactcatcagttcccttcaattagggcacaaacaagttgaatctcttcctcacaaatttatgtggatagtctgctgctgtgagcttcctcttcaacattgtctcattccttctttttttttttttttttgagacagggtctcactctgtcacctgacaccctggcactgcacagggtggagtgcagtttttgtgattatgtctcactgcagcctcgacctccctggctcaagtgatcctcccacctcagcctcctgggtagctgggattagaggtgcacaccaacacacctggctagttttaaaattttttgtagagatggcgtctcactatgttgcctaggctagtctcaaacttctaggttcaagcaatcttccctccttggcctatcaaagtgctgggattatagatgtgagccaccacacctggccttcatcccttcttaaaacaggttatccatttgtaaactgctgatttcattttttaaattttcttttcttttttctttctttctttctttctttctttctttctttctttctttctttcttttttttgttgagagtctttctctgttgctcaggctggagtgcagtggcacaatcttggctcactgcaccctctgcctcctgggttcaagtgattcttgtgcctcaccctcctgagtagctgggattacatgtgtgcacccgtaatcccagcactttgggaggctaagtcaggaagatcacttgaagcttggagtttgagaacagcctggccaatgtggtgaaaccccatctctactaaaactacaaaaaaatatataaactgctgatttctttgggcattgtctctgtaaacttttcataaaacatcaatgatttcaccatgcatccacccagcttcaccataaatatgaggtttttcttgtttcaattgtagcagaattcatgttactctcacaggcgctctgttcaaactgatgtcctatccttcatagcgcttcaagctagatcctgttcggacatgttagtgtttattttggtgcaaaaaatttttgaaatccaggcatagttttttttataatatgtatttccatgaacagtttgaagacccctcatatataaagcaaaatctcagaggctgaaagaacaaatagacaaattcacaaatataatcagggacataaacactcctctctcaataattaatataatattttacatagtaaataaccaaggatacagaataactgaatattatcaattatctctagctgatatttatagagcatttcactcaacaacaggagaatgcatattcacattcttttcaagtgtacatggaacattcaccaaattgaccatatcttcagtcataagacaaaatttaacaaatgtaaaagaactgaaatcatatattgtaagtttgctgatcataatggaattaaaaaaacaatagtggaaaataacaggaaaatctccaaatacttggaaattaaacatgcatttctaaagaacccatgggtcaaagaggaagtacacactggagacagtggctcatgcctgtaatcccggcactttgggaggctgaggcaggagaattgcttgagcccaagagttcaagaccagcctaggtaacaaagcaagaccccatctctacaaaaaataaaaaaagattagctggacatggtggtgtgcttctgtagtctagctactcgggagactgaagcaggaggatcacttgagcttaggagtttgaggttatagtgaactattatcatgccactgcactccagcctggacaacagagtgaaaccctgtctcaaaaaaaaaaaaaaaaggaggaactacaaaggtaaaattagagatcattttgcactaaattagaatcaatatacaaaaatatcaaaatacaaaatataaagattggtgggatgcagctaaagcagtgcttagtggggaacgtgagtcaaattgttgaaataaattgtaaaagtaccagcaaaactaaggaccgaccttattgctagtttccttctttgctctgaccacattttggtcatttattcatttaacaaacattgataaacacgtattttatgctaggctcttaagtgtttaaatgtcatctttagctctaggctctgggatcctagtgtagtgtctctgggtgtagcatagtatttgggacatggtaggtgctcagtatatacttgtggactgactaaaaataaccacaagagatcctcccctgtggtgagaattgtggcgcagatttgggggccaggagaactttctggaggtagtggcaataaataattcagttctaaacttgttctgaaagtatttaaccagagtacggatttttattattgaaacattttttttcagttttcattttcttccttttcttggggagtatgtaaaataatgcaagaatgctttctaaatgagtccacgtttattctttggatatttgaatatggtatgtaactctggatacgatctcaaagcaaaaatgatttagattgaagatttttgtaaaaagcttgaaattgaagtataccgctaatacaaatgaactttttaaaagtggtgtgccagaaaacagtaaatcagtttggtaaatatgtaactgtagacatccaagacagagaaaatgaggcctgagttaagggactaagatgaagggagatatttctaaggcgaatcaacaaggagaggtggcgaattgtacatgagggatttggcagagatactgcagctcctggcacgacaagaattaggatttgtaaaaagttagtgattctctctccctgccggtttacatcacaacgtaggtgttgatctagggagggagtcaatgagatagagcattgcagagcttgctagagaggcacaggaagttgcctgaagtgaaggagggggtagcggctgcagaagctaaagcttccgccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtctttcctgttcccctcccgcggagaccagtaaattacgtactttgcaacagtaggtgtgacttcaaggtcaaggcttttttttttttttttttttggttcttttaaagtataagcaaagaagcagaaaccttagagccctaagaggcataggcacttgtccaaatgatgttcttttttttttttttttttaactctaaacaaaattacacatcatttagatactattgcacaggtttcagtcttctacacattgcatttatttttttatgttgccatagaattgaatcctcagattttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaataaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtgttctcagcactggagatacaacagtggataacaaaaacaaagtcttttaaactatagctgggagacagacaataacttaatatataaacaatatatattggcaagtggcactggtgttaaatgaacgaaacaaaaaaatacatgaagaaataaaaaagaaaaaaacaaaaaaagaaataaatatgtaataggttgtaatgtggacgggttctactattttagataggatgggcaggaaggcttcactggtaaggtgatatttgagcaggaacctgaaggaactgagggcacacactatgcagatattaatgggaaaacaggatttatgtcatagtctttgcatttgttcactctgtttcctaacccgcggccaccttcccattcccctagtggtcacttttctgcatagcattaattcaacgctctgcatactcaaataacctgatccattcacattaatttctcatattctcttcctcctggctagcttcttgctaccatttaggcgacttgtcagcctctttaggaagacatatcactatctccatattcacctcatcctcagtttgttgattgctggtgcattgtgtgctatcctacaggatatttgattatctctctcgctgctcttaccactttgtgttcataatatgttgtccataaatatttggtacggtaaagtgaaatgaattcagtgcttgtttataaaagataaaacttttaaatatggctttccccctaatgttcaacactattctctaaggtcagtattatcattgtcattttactaatgctaaaaccaagactaggaggtatgtagtaacttgctaaactgtggtacagtttatggagttaaggtttttcaggcactcagtcctggtctggttctctctatctgtttcttaatgagaaataaaaaatatacagaatattttattattttataagacaatccgggtatagaaattttattttttgtgcttctttcacaacttagatcatatcaggtgcttgaattactccctaattataaatattaagctctgagaggcatgaataatgcctctttttaccagaatatttttaaataaaaaattaaacaagcagaagttgaaagaagagtacaatgaaaacttttatattctggacctagattcaacaactgttaacctttgccatattagctcactctctctattactcactctctttctccatgcatccatccatccatccatccgtccatccgtccatccatccatttatccatccatctatctatttttttatctattttggctgaaccatttgacacttgcaggcattattttaagtaaatgtaaatacatgcagaaaagtgcacattgtcctaagtgtacagctcaaagcattttcttttcttttcttttttttttttttttttttttttttttgatggagtcttgctctgtcccccaggctggagtgcagtggtgaaatcttggctcactgcaacctccacctcctgggttccaacgactctcctgcctcaggctcccgagtagctgggattacaggcacatgccaccatgcctggctaacttttttacttttagtagagacggggtttcaccatgttggccaagctggtctcgaactcctgacctcgtgatccacccgcctgggcctcccaaagtgctgggattacaggcgtgagccaccgcgcccggccagctcaaagcattctcacaaagtgaactcggctgtgtaaccagcatcaagatcgggaaattttgaaagcccctaaatgtatcccttatttgttactattccaaattaatcacaatcctgtcctctgtcattgtataataataattttgtctgtttttaaactttaaaaagtaacacagtttgtgttaattttttggcttgaggatttgtttttgagattcatccatattattgagtgtagtagtaattcctctattttcattgctattccattgtatgaatgtaccacaatgtagttatccttttattgtagatgacatttttgttgttttcattttcagcttgcaaatagtattgtgagcattctagtacatgtcttttggtgatatattcacacatttctgttggacatatacctaagagtagaattgctgaatcacaggttatgtataagattaattttagtaaatactgccagccagctttccaaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaataccactgtcttaattaatgtaacttcacaacatgccttatgtatggttatgtgagtcttacacttttgttctttttcttcaataatgccttggttattcctggtctttttccttatacgttttagagctagtcaatttctacaaacattcttcttggcattctgattgagataccatctaacagatcagtttagggagcagatatcatggcacgtcacccttaaatatctcagcattcatctcctaatattagcattactttgtagtaattaattaccattatctcactaaggaaaattaatgattccctaatatcaacaaatacctaatcttttcaaatttattttcctcaataagcctttgtaagctggtatttaaaactatcatccaacctagattaatgtattgttaagtttttggggattttattggtgttattttctctcctttgttgaacttgtgaatatttatatatttagtacttttcaatccattgcagtcattatttcttctgttgttccaactgtccaatcatgtcaagtgggagcccattcacattcacattggcttctgtgtcttttctcttttgttacatacattttcaaatatattcaaagtagaaaatagtaaaataggctgtgcatggtgactcacccctgtaatcccagcactttgggaggccgaggtgggaggacaacttgagcccaggagttttagaccagcctgggcaacaaagtgagaccccatctccacaaaaaatttaaaaattagctggacatggtggcatgtgcttgtagtcccagctacttgggaggctgaggggggaggatcgcttgagctggggagtttgaggctgaagacagctgtgattgcaccagtgcactccagcctgggcgacagagtgagaccctgccttagaaaaaaaaatagtaaaataaacatgaatgtatccattccccagcttcaataattaacaacattttgccaaaactggcaagttttgttttatctattctcacccatttttttccacatcccagatatgtcattacacaggtgaataactcagtatgtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttataaagcccttgcatagtcccctttttattttattttattttattttttttttgagacggagtctcgctctgtcgcccaggctagagtgcagtggcgcgatctctgctcactgcaatctccgcctgccgggttcacgccattcttctgcctcaggctcccgagtagctgggactacaggcccctgccaccatgcctggctaattttttgtatttttagtagagacggggtttcactgtgttagccaggatggtctcgacctcctgactttgtgatccacccgcctctgcctcccagagtgctgggattaattacaggcgtgagccaccgcgcccggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccattgatgataattgcctagattcattatttctgtagaggttgaaaaatggtgatatttaattctttcaatctttctgcattattaactggaattactttataaagaagactttttccttatcagctattttttgtcctgaagtatatttcataataatcaagataaatgatgctgccgctgctgctttttttcatttatcagtgttcatagtaatgagttggtttcttagcaaccgccactgttttctttaatatcattaagaattcatggatttttatgtattttaagtgtatcaacccattgtggtcattttttaatgcttaaacagtgtcatcttataaattaggagccccttctgttttcacttctatgttttttttcacattatctcgttagtctttgttggcgtccttgctttttggcataagctattttaggctcatcatgtacactccctgccccacccctggaattagccattttacaaggaactatgtaatttttcagtgaaccttggtatttagaaactaagatgggaatactcaggggattattattttaaaagtcatgctacctgatctttagttgtgctcttttccctgctattgtgaatacattggaatgactcttgcagcattttattgaaaattcgctaaacatggctttcatttgtttatgtagtcattcattcagccaaaatttatagaatgcttactatcatgtatctggtcttatgctgggcacagggaatgtgagggtaaacctgactggtctcctgtccttggagaagactcattctagtgtggatatgagcaaatacgcagtgtctaaagagcagtgaacagtactgtgttcatactctttagacactgagcatactctgggcataggcaaatgggctataggagcacagagaggacatcccaaaatgctttggaaagggaagataatgcttgatactggtgagtaaatgaggtatgaaggtagaagagtaatgaagagtgttccattcagcaaactggaagaagtaggggggaatcttgatatagtcaaggaaaggcatatatgtagttggttatgatgggaacataattgtgtaagtttttcagttttcagaagattgacaaaatagtctatttaccacagacatgaagatgtaaaatgttgtatgtatgtgttgttgatttttattttaaatctgataatgaaataatccaaattctaattaaaattagtatttaatgtacttcttggacctgatcatattttttagttatttcattaatgttaaagcatagttacagttaggagatgtctatttcgtgttttagttcactgcttctttattttttactattattttgctttatacgtgttaagaatctgaattttcaagatatgacattaaaaatagtggcatatttattgtggctcttcatctcccttcattctttggctgctatttgtgtcaacccgtttaataccataattacagccccttacatactcacaaggcaaagttgttccagaaaacatgtcatctctctttattaccaattggacattatactatacctgttacattttacagcatgttgcacctgaggctatccatctgacagatactgcatgaatagtatgttaaacacaggtttgtggtttaccggagtgctatggtttaccagttgggaattttgggaccgtgagtgtgggagaatcactaggcttaggaaggaaccacatctcatatgtggccaggaggtgaaggggtgttctagaaatcattgaagaatgtggggaagcttattttttaagggggattctagaggtcacaaagaaaagattccaggtgggaaggagagcagtgaaacagtagattaaaggggaagtgggagtagattactacttttcattctctctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaataaataaataaataaaaaactgaattttgacaaaaaaaagctgtgagtgggaccagagagcaagtggtcattggtcatttagacgatgtaaagtagctgactggatatgccatttagccttgagcttgaaagtacctaaaataatgggcaatttagaggttactctgtggtctagtaaagctaaggaaaaggggcaaatggaaaggaatagttttataaatggtgtccccattctcccagcccatggcaaccactaatatactctctgtctctctgaatttccctattctgaacatttcatataactagagtcttgaaatatgtggccttctgtgtctcacttcttccagttagcatagtgttttcaaagtttatccatattatagcatgtcttagtatttccattccttttcatggctgaaagatattccattgtatgagtataccaccttttatgtattcattcatcagattgtagatggacagatgagttgtttctactttttggctattatgaataatgctgctgtgaacttctggtatacgtttttgtgcaaacatatgttcttctcatttctctggggtatatgcctaggagtgaaattgatagtaactctatacttaactctttgaagaactgccaaactcttttccaaaatggctctaccacttaaattcccaccaggaatgtataaggttccaatttctccacatccttgctaacacttgttgttttcctttttttttttttttaaattacaaccatcttagtgagtatatataataaagaatctcacttaatttttaaaatataatatttaaccgctgacatctttttttttttttttttttgaggcagactttcactcttgttgcccaggctggagtgcaatggtgccatctcagctcaccacagcctccacctcccgggtttaaccgattctcctgccttagcctcctgagtagctgggattacaggcatgtgccaccatgcctggctaattttgtatttttaatagagacggggtttctccatgttggtcaggctggtctcgaacttccgacctcaggtgacccacccgcctctgcctcccaaagtgctgggattacaggtgtgagccaccatgttctgctaactgctgacatcttttaagcctcacctctccctcttcattttctgctccacaactgggcaagttaattagaaagcatgagtgcttcatcctttggagctagcaagagattcaaaccatgcaagtgtcttcctgaatgtaagaaccctcactcctgcctcatcctttaaccacagtaaaaactcaatttagtttcctttccttgctttttctaacctgcttaggagacttgccttgctgtccccagaaatgcattgtttatgtaagtaagtagtaaacattttcataccctctttgtgtgtgaggtgttatcaatctgaacactggaatcaaaatttgggtggggtccctccttcttctgcaggatggcaagaacaattggcacagtgagcttggtgctcagataatgacagccatcatggggggaagggagtatctttccttaattgctttggctcactaattggttctgatggcaagcataaacattgagcctgcaagggtagctagttttttagttgtactgtgctgtgttgtattgttgactcctgtagaacctctcttacagatttagctaacttggaagtttaggtaatttaatggacattgaggaacagtagtatgggatccttaaagtagccctggatcatgtgtctcagcccagacctatttgtgtgtcttaacgtaaagctgtgactgatgctaggctcaggaggaaaaccatgtctatgactagctggttttgtgtctcaattaggctctgaccctgacagctgactgcccattgggtggtcgctcttgagagcagtcatcagggagtgaaaaaaagagagagaaaagagaaaagaaacagctattatgtggcttgctggggtctggacttcgaagcacaaatgactcactagaacccttaaatacctccgttgttatggctgttgctgctgctgctgccgctgccgctgctgctaccgccgccgccgctgccgctgccactgccgccaccaccacctgtgcttctgttgcaacaaagatcctgatcttcaggattatagggaaaaacattagtggcacccctgtagcatggagaaaggggtaattcaaacccataaagctcctagtcctttaatcttatatgaccaccattgcctttggggaggccccttacagtgacagtgctgatttgagactttctgcaggaagacatttataaatatgagcaggttagggaccccgcagaaatatatccagtaacaacagcaacaaaaaaacaagtacagtcatgtacagcattatgatgttttggtcaatgacagatcacatatgaggacggtggtctcataagactataatggagccgaaaaattcctgtcatctagtgatgtcatagctgttgtaacattgtagtgcaatgcgttactcacgtatttatggtgatgttggtgtaaagaagcctgtagtaccagtcatataaaactagaacaagtaccattatatatggtacataatacttgataatgataaaaaaacagctaggtgtggtggctcacgcctgtaatcccagcactttgggaggccgaggcaggcagatcacttgaagtcaggagtttgagaccagtctggccaacagggtgaaaacctctctcttaaaaaaaaaaaaaaaaaaaaaaagaaattagctgggcgtggtgacgcacgcctgtggtcccaggtactctggaggctgaggcatgagaatcgcttgaacctggggggcagagcttgcagtgacccaagattgtgccactgcactccagcctgggtgacagagtgagaccctgtctcaaaaaaaaaagatgaaaaacaaccatgtttatgtatttactataccataatttttatcagtattttaaaatgtagtctttctacctattaaaaaaaaagttaactataaaagagccacagacaggtccttcaggaggtattccaggagaaggcattgttataggagatgacagctccatgtgtgttattgcccctgaagaacttccggtgggacaagatgtggaggtggaagacagtgatattggtgatcctgactgtgtagggttaggctaatttgtgtgtatcttagtttttaagaaaaaagtttaagaaataaaaaattttaaacaaataagcttatagaataataatataaagaaagtatttctgtatagctgtataatttttttttttttttaagatggagttttgcttttgttgcccaggttggagtgcaacggtgcaatctcggctcactgtaacctccgcctcccgggttcaagcgattctcctgcctcagcctccggagttctgggattttaggcgtgtgccaccatgcccggctaattttgtatttttagtagagacggggtttctccatgttggtcaggctggtgtcgaattcctgacctcaggtgatccgcgcatctcggcttcccaaagtgctgggattacagatgtgagccactgtgcccggccatgtgtttgtgttttaaaagctaaacatcattacaaaagagtcaaaaagctttacaaaattttaaaaagtttataagtaaaaagttatagaaagctaagcttaatttattattgaaagaaatgtttaaaaaatgattttagtgtagcctaagtgtactaaagtgcacattagtgtacagtaatgtcctaggccttcacattcactcaccactcattcactgacccacccagaacaacttccagtcctgcaagctttattcatggtaagtgcccagtacaagtgtaccatattttgtctttttttttttttgagatggagtttgactcttgtagcccaggctggaatgcaatggtgcgatctctgctcactgtaacctcctcctcccaggttcaagtgatttctcctgcctcgccctcccgagtagctgggattacagatgcctgctaccatgcccggctaatttttgtatttttaatagagatggggtttcaccatgttggccaggctggtctcgaactcttggcctcaagtgatctgcctgcctgtgcctcccaaagtgctgggattacaagcgtgagccaccgcgcctggccatatttttgtcttttataccatatttttactgtaccttttctatgtttaggtaggtttagatacacagatacaaaaatacacagatacacaaattgtgttaaaattgcctacagtattcagtacagtaacctgctgtactggtgtgtagtctaggagcaatagtccataccatataacacaggtgtgtagtagtgtataccatctaggtttgtgtaagtacactctgtgatattcgcacaacagtgatgaaatcacctaatgacacatggcatttctcagaatgtatctccattgctaagtgacacgattgtaaaagaaagaaaaaaaaaaaacagatatgagaggcagaggaaacaaacagaaacggagatccacaatttgacccaattagaatccagaatttatggaaaaattttactaaaagagcaaaaagataaaagggtgctgattggtgttgaaatgcagtgggtggcaaaacttcatgaccttaattactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagttcatcttgaatgggggtcccctccaacaagaggttctagaatctgtcaaaattgcaatatgacactaatgacaattagtcactaacgacaatatcgttagtgaccccagatgcgcttcaccatagaggttttagcaacttcctcatttctccctctggaacatccatcattgccataagttgccaagggtttctgaggcaagagactgtcatccttggacctgttttatacaccattagagtgacaattgctagctgcatagtggactgtcttagaaatagaggctatcacaatccctcagcctgtgaccctccatatccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacctcacagatacccaaaatgtaaatcaagttaacacatttatcttcacatagtgaaggtcaaacataaggtctcaccaagagactccttattttccttcagaatttgaggcatcattgatagtgatgaaggcactcatttcatttcttagaatatacagtcctgggcttaatgaaggaatacaacaaaacatttactttctttacagacttcattctgaaggacttacagagcaccatactggcttcattaaacaaatgtatatttgattaaatgaacatggcacatttcagtcattagacaaacatcaggggtgaattgtaagattctgactctattttttcaagtttgctgactttttttttaagcttcaccttcttcccctctgccccacatcgggacaaattgataagaagctctggttgctccctccttgggggtcaggaaaagattcaaaccatggaagctccttcatgtgtataggaagccttacactgggccctaaccacaacgaaaacccaagcttgtctcctttccttgttctgtcaagccgtttcttacctgcttgggaagcctgaccttctccaccaagaaaatcttcatttaggtaagtattaaactttcttgtaccatcttggtgtgtgtaaccagtctcaacgtctaacctaagtttgggatgggggtcccttcttcctcttcacagtgtcaagtagtacctgattgaggttcttatttgcatttccctaatgactaatgatgttgaacgtatttccatgtccttatcggctatttgtatatcttctttagagaaatatctattcaagtcccttctttttaaattacattatttatatttttaattgtttagtcatatgactttttatgtattgtgggtattaggtccctaacagatacatgattttcaattgttgtcttccattttatgggttgtcttttcactttcttgatagtgtcttttgagtacaaaagtttttcattttagtgaagtccaagctgtctaatttttcttttatagcttgtgtttttgtgtcttatataaaaattgttacctaatcaagttcacagtgatttacacctatgctttcttctgtgagttttataattttagcttctacatgtaaatctttgatctcttttgagtttatttttgtatgtggtgtgagataggggtccagtttcatttgcatatagatatccagttgtcctggcaccattgtttgagagactatacttggcactcttgtcaaaagtcaattcaccataaatataagggtttatatctacactctcaattctgttcatcagtctatatgtctacaattattctagtaccttagaatcttagtaactgaagccttgtagtaagttttgatattgggaagtatgactcctccaactttgttccacgttttcaaaaggtgttttgaccattttgagttacttccattttagtattaattttagggtcagcttgtctgtttctgcacagaaggtatttagaatttcaataggaatttcagtgaatctatagatcagtttggagagtattgccatcttaacaatattaaatcttacaattaatgaaaccaagtgttttcccatttttaaaggtcttaaatttctttcagcaatattttgtagttttcagtgtacaagttgtggtcccacacattaaggtccccatacccagtattgttgacaagtctttcacctccttggctaaatttattcctaagtgttgaatttttcttttatgctactgtaaatggacttgttttcttttttaagttttattttatgtttaattgatacacaataattctatttatttatggggtacagtgtgatgtttcaatagatgtatacattgtgcagtgatcaaatcagggtatttagcatattatcacctcaaacatttatcatttccttgtggtaagaacactcaaaatccttcaactagttattttgaaatgtataacgcaatattgttaattatagtcattctactgttcaatagaacaacagaacttgttgctcctatttaactgtaattttgtaccctttaactagtctttctgcctctcttccaccccactttttccctctactctcctcagcctctggtaaccactattctaatctgtacttctatgagatcagcttttttaagattccacaaatgagtgagatcatgtgctgtttgtctttttgtgcctggcttatttcgcttagacttgttttcttaattttatttttggatttttcattgcaaggtagaactacaattgatttttgtttatgatcttgtaacctgcagctgtgctgaactcatttataagttctagtagtttttagtggattccttagaatttttacattcgagatcatgacatccacaaatagagatagttgtacttcttcctttataacttaagtgcctttcattgtgttttcttttaaaattgcccttgttagaatcttcagtacattgttgaagtggagagagtagacatccttgtctttttcgtgattttagagggaaagcttttgatcattaattatttattgatattattattattattagagacagggtctccctctgtcacccaggctggagtacagtggtgcaatctctgctcactgcagcctcgacctcccgggttcaagtgatcctcctgcctcagccccccaagtagctgagactacaggcacatgccaccttgccggatagtttttgtattttttgtagagactgggtttcgccatgttgcccaggctggtctcaaacacctggactcaagcaacctgcccgccttggcctcccaaagtgctaggattacaggcgtgagccactgtgcctgggcctgatctttaattattaagtatggtgtttctgtgactttttcctagatgccattatcaggttgaagaaatttccttctgttcctagtttaagggttttttttatgaaaagttatcgggcttaatcaaaggctttttctatatccattgagatggtcatgtggttttcattttttatgctgttagtatagtgtattacactgcttttcatatatttatccagctttttatttctggaatagatctcagtcatggtgtggagttctttttaatacgtgtcagaatttggtttgcttgtattttgttgaggattattgtgcttatattcataagggatattggtctgtaggtttcttttcttgtaatgcctctgtctggttttgctatcagaacaatactggcctcacagaataagttaggaagtgttccctcgtcttccctccttttaaggagtttgtgtagaatttagcagtgaagccgtcttggccttggcttttatttgtgggtagtgttttgattactaattcaatgtcttcacttgttataggtttctttatcttatctatttcttcctaagtcagattcagtagtttttgtttttctaggagtttgttttatttaagttaatctgattttttgccatacacttatttatagcatttttttataagattggaagtaatattccctctttcatttcttattctagtaatttgagtcttctatcctttttcttgtcattctggttaagggtttgtcaattttgttgatcttttggaagtaccaacttttattttcattgatggctctctattatttttcgattctctatgtcatttatttactccttggtctttgtattatttccttccttctgtttgctttgagtttagttttctttttatagttaattaagatgaaaagctagggtcattgttttagatctttcttgtttttcatatatttatccagctttttatttctagaatagatctcagtcatggtgtggagttctttttatacgtgtctgaatttggtttgctagtattttgttgaggattattgtgtttatattcataagggatattgtaatatagttattacaactataaattttcatcaataaaaaatactgctttcactgcatctcatatgttttggtaggttgtgtttaagttttcattaatttcaaagaactctctcatttcctgtgtagattcttatttgacctttggcttatttagaggtgtgttgtttaatttctacttttgaattactttacaaaatatctttctgttactgatttctaatttaattccattgtggttggtgaagatactttttattatttcagtccgttttatggagacttgttttatgatctaacatatggtctatcttcgatgagaatatttaatatgcatttgagaagaatgtgtattcatctgttactgggttaagtgttctatagtgtctattaggtgcagtcttctttttccttgttgatctcctgtctgattgtttttatctgttattgaaagtgggatattgaggcagccagaatatgttattgaattgttcatttctctcttcagttctgtcagtttttggaatctgttggtagatgaatgtaagtttatcatagttatatttttgtgatggattggcagcttaaagattgcaaaatgttattctttgtctgttttaccaatatttgttttaaagtctattttgtctgctattagtataaccactcctactcttttttgggtaatgtttatatggtatctctttttccattcttttacgttaaacttatttgtgcctttgaatctaaaatcattctcttgaagataatgtatagttgggccataactttttttgtcgatttaactagtctctctctttattggagagttcaatccattcacatttagtgcagttactcttcaggtagaatttacatgtgtgttttgttatctgtcctccttatgtcttatgtcacttttgtttttctattcttacattactgctttcatttgtcttaaatattttccactgtgccatttcaattcccttgttgtttctttgctatatattttggtattttttttttagttcattctttggagattaccattaacatctcaattgatgagaatctagttcagatttatatgaacttactgtcctagaatacaaaagctttgcttctttaatagcactgtaaccttctttatgttgttagtgtcacaaattacgtctttttgcactgtgtgtccatcaacgtagatttataattattgtggtagtcatgttttaagtcagactggaaaacataggaattgcaaattttaaaaaagcaacaactatatttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctgagcatgcacacagccctatacatgcagatggtcttctatattccctagaaaatatcagaactcttcaaatcccctattgatagcttattcctcagcttttcctttcattctttttatttagtttattgtttgctccaagtgttatcatttgtggaggggcttttagtatgggttttgcactgaatcaaacataaaccttttaagtagcgtcttctggggaaccaacagacaggacaaataatgacagttctttagaactgaagctttgggagttgatgccactgctaaacagctgagccagctaatgtagttctttgacagcacagaaatgtagggagaaatgagcagcccctggctgaaatgccgcagactctccttgttcttacttagttctgtagattttgttgccgttgatcaatccccagagactttaggtgattggctttgcttgttttgaccagttttattagatgtctctttggggaggagatttcactgagctcctcacatagccattccagaattcccataagtttggtgttgtatctaaaacctcattgctaaagcctaaggtcatgcaagttttctgttttcttctagaagttttataattttctgttttatatttagattcgtgatccattttgaattaattttcatgtgaagtgtgaggtttgtgtcataattttattttgcacatggattccagttgtttcagcaccattttttttggcaaagattgtccttctccattgaattacctttatgcttatgtaaaaaaaaatcagttgactaaatgaaataaactgattaaaaaataggcaaaagacctgaacaaagacacctcaccaaagaaaatatacagataatatataagcatgtgcaaagatgctcaacagcatatgttattaggaaattgtaagttaaaaaagataccactacacatttattagaatgttccaaatccaaaacactaagaacatcacatactggtggaaagatgaagcgacaggagctctcattctttcctggtgggaatacaaaatggtatagccactttggaaaacagtttgacagtttcttacaaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctcaaaaaaacaaagaaaaaaaaaagaaagaaaaggctacatactgtatgattccaagtatttgacattctggaaaaggcaaaactatggagacagtaaaaagatcagtggcttccagggtttgggggttgggaatggatgaatagacggagcacatgggatttttagggcagtgaatctactctgtatggtactataatagtggatacatgtgtttatacatttgtgaaaacctatagaatgtacaacactgagagtaaaccccaatgtaaactatgaactttaggtgagaacgatatgtcaatataggtccatcaattataacaaatatacatacccttctggtgggagattttcatagtgagggtggttgtgcatatacgggagcagagagtatgtgaggaatctctaccttggactcagtttttatgtgaacctaaagcttatctaaaaactaaagtcaattttttaaaagtcaactgaaaaaaagaaatgcttctctctcccacaccttgccccaatcctcaggcaataataaatggttttgcggtatcaaaaaaaatctgtgattgtatttgtgtggatctatttatggcctccctattctgttctgttgatctatgtgtcatttcttttgctaatactatggcaccttgattactatagacttacactgcgacttgaaatcggataacatgagtcctctaacttggttttcctttttcagagttgtgatagctgttaggtcatttgccttttcatgtatattttttagattcagtttagctatgtctacaaaatgcttgctaaaattttgattggaattgtgtttatatggctttaattgagcattttatctctctctttgcatatcatttatacttgtttttcttaactttttagtggttaccctagttttcacagtacacatttttaatctaagtctttcaaatactattgtattgcttcctgtgtagtgtaggtaccttataagagttatcccccgtttctcccttgctttctttttgacattgctgtcatccctttcacttacttatatgctacagtcatttcatacattgtagtgtttttactttatacacagttacctcctagattgattaagaaaaataaaaagttttatattacttatatttatttttctctgactttctttatgaagattcaagtttctgacatgttgttttttttttgtgcctggagaacttcttttgacatttcttgcaggacatgtcagcttatggtatccagcagtttctctaccatgtaaacaaatcataagtgctagatcttcctgtctctccaaatgttcaagtggtgatttcccatgtggcctcagttctctgatgatttttaaaaagttattgattttcattttgtctagcttttcggtcttgtaagggcaggagtgacatcttcccagttctttacaatttggagctacaattagaggtgctcacatatgtatttttaaatttttcttgtggatatgttgccaaaaacagtaaaaagaaaacaggtgaaattaattttaataaagtattttattaaacccaaacaacaaaaataacattttaacatgtagtctgtataaaaatacttaagagctattccacattaaaaaaaaaactcttctaaatatcatatggattttttctacttgtatcacatctcactttgaactattgcatttcacgttatcagtaacccaatgcggtttgtggctattgcattgggcagcacatgtccaaagagaatatgtagaaagagaaggaaggagagttgaggatgaacttttggggatacagttaggtattaagcagaggaagagaggcctaaagacagagaaagaaaagtcagagaaaaattgaagacagcaaaagtataactgaaacaaagggaagaatatgtttcaaggaaaaataagtattcaaatagtgtcaaatgtggcgaggagctcagggtagatatggagtagatatgggaattgacaaatggaaaagaatagagaatacagaaatagaccagtgtgtttgtgtatgtgtgtgtgtgtgtgtgtatatgtatatatatgtgaaattagtaaatgaaagaggtgtcaacataaattaatagagcagagtatatcattcaatacatggtgatgggacaattgattatccatatagaataaaataaaataccaacaccaaaaacaaaccattaattttttatagattataaacccaattatgaaaagcaaaactttaatttttaaaaaaaaaaattaggggactgtttattatctcagggaagggaagggttgttgaaacagaatgtataaagaatgcctataaatcaatgataaaccatccaatccgaaaaatgggcaaagttatgaacaggtaatttataaaaaaggaaatacagaagtccaataaatacattgaaatgtggtcaattgcactaataacaaggacaagggactgaaaatcaaaataatgaaatgtcacttttaacatatcaggtaaaaattttattgtttgacaatacctggtattggcgtggttgtagggaaacagtagtcttcatatatggctgatgtgggtggaaagaaatacaatcacattcaaatgaaattaattgtcaaggatctagtaaaattgtagatgggcatttccttctgttgcaacatttccaattctaggagacatggaagaaaacattgcggtattacgtgatattgtgaaaaactggaaataaactaaattccccaactgttccaaattaataggggaatgatcaataactcatcagtcatcatctattcatacagtgcaatttaatatggcagtgaaaatgaagaaatcacatcaatatatatcagtgtcatcttaaaaacataatgctgattgagaaaagtgagttacagaacaatcacataatataccatttatataaacttaaaacatacaaaaatactatatattgctcatagatacagatgtgtttgaaaatgtatgtataaagaaggaatagaaatgatgcacaccatatcaaatttggttgcctctggggagaggaaaggataatggctaggggtgggtttaaagagtacttcatctttatctagaatgtttagtttatttcataaaatagatgaagcaagtgtgactacatttttaaaaatgttagcaattgttaattctgggtggatattctatattattctatatttttgagatatttccaaaataacaccaataccaattaaagtttataggagatgaggaaagaggaaaaaaaaaaaaggtagtacctggagaaagatgcagaaatctggaggagaaattactttcaaggtggtaaaaactcaaatagatttaactactggtgggaaggagcctagggagagggagtggttcaaagtacaggtgtaaggagagatgattaaagtaccaggacccagcttgtgaggagtgaagcacagccattttccccaactgatctatcatgtatttgtcacctaaggcaaaaatgtatttcttaactgatacagctatttgtaataaggtttcatatgctgtctcctttgtgttttatatatttatttatttatttactgagacagagtctcactctgtcaccaggctggagtgcagtggcacgatctcagctcactacaacctctgcttccctggttcaagagattctcctgcctcagcttcccaagtagccgggactacaggcgcgtgccaccacgcccagctaatttttgtatttttagtagagacagggtttcaccatgttggccagggtcttgatctcttgacctcatgatccaccttcctcggccttccaaagtgctgggattacaggcgtgagccactgcacccggccttcttggtgttttatatatgataactacatatcaagcaactgttattcccaatcttgacttgaaaaagtaacaaaatgttcctaacaaagttacactgagatgcaagtacagtgttttctgacatagctcttgcaaaaaatattggcaataaatgtatttaaaaataattttaggctggaggcagtggcttaagcctataatcccagcacttggggaggccaaggcaggtggattacctgagcccaggagttcaagaccagcctgggcaacacagggagaccccatctctacaaaaaaataaaagaattagtcaggcatggtggtgtgcacctgtggtcctagctactcaggaggctgaggtgggaggatcacttgagcccaggaagtgaaggctgcagtgagctgtgatctcaccactggactccagcctgggcgacagagtcagttgctgcctcagaaattaaattaaattataaataaataaatacataataattttaatgattaagaaaatttcaggaattagtaagttcccaatattgttgtttgggcattggaagcaatgtactatgaatctttaaattttccaaatacagagtttccaaaagataaatggacatcctcactgggctctatgggtaacttccttttcatcttctcccactttgcaggctaaacaggcactctgcacttttttcctttttaaagaaattatttttatttctaattattatggctatataatagttgtatatatttatggcatacatgggatgttttgatacaagcatataatgtgtcatgatgaagttagtgtttatcatttgtgttaggaacattccaattccactctgttagttattttatttttattttattattcttacttttttgaaagaagatctcactctgtcacccaggctggagtgcagtggtgcgcaggcggttcactgcagctccgccttccgggctcaggttcctcccacctcagcctcctgagtagctgggactataggcgcgcaccaccacacctggctaatttttgtatttttagtagggatggggtttcaccatgttgcccaggctggtctcgaactcctacgctcaagggatctgcccaccttggcctcccaaagtcctgggattacaggcatgagccactgcactcgatctcctttagttatttttaaatatgcgataaattattgttaactatagtcaccctattgtgctactgaatactagatcttattcattctatctaactgtatttttgtacccattaaccactcccactttatctctccctctctgctactcttagcctctggtaaccatcattctactctctccatgagttcagttttttttttagcttccacatatgaatgcaaacatgtgatatttatctttttgactccacttcttttttcccatccaggctccatggaggggaaagagaagggaaaaggtagacaagaaagattggaaacttggtcttgaccctgctactcacgagccttaatgtgtcttcttacctcttcttttcctcacctgccaaaacctctgcagccctacttctgcatgcctccccaccttcactcttcaggaattactaggaagttctactcatactgggagtcaaatgggatatcaaggagataggtaggagaatcagcagtactaccagggatatagcactggaagataggttcttagcatctcagtgttagcccccttttattaatttctcataaaagcacattgttttattagtggtctttatctacaatagtattggaaaatttcagcaccaacataggtcaagcaatcttatgtagtccaacgtaagtacctaactaccatttatggcattttctttttttaaatggaaaactgttttgtaatgcaattttcttataaatggtagtttggggctacatttaattcatgaaagttagtaagaaagtagaagaagaataaaagtttgagttgacaaatcccatatgtgaatcctttgaaatgtttattaaactaaagcattatattgtggttagatttcaggaggtaaaaagtggtagaaattactttatttagttttttttttttctacaggaataaggtagtggaattgctctctgataccctaagtcagtcaaccagtctctcccaccccacacacatacatttagttttttctatatttctcaaatgtgaggtacctttaatttcttaaaaaatcttagtaagtgtgctgttgctgaatcaattttttttacattaagtactacagggtttcatctgtcattactttttgtgctaatcattttgtaacttttatctgaataattcaatacttgtaactaaattatgtttgaagattcttaatctatataggataaaacttgttttattacatttcatttattagtgttactcatattagtaaagtgtctactttttctctatggttgtcagaagctggagaacaccaagtaatttaagatttatttgatttgagactttaccatcgtcaggatatttaaagatatttaactagggacagtatatgtgttaaaagctgacttctactttataaaatcacgaaatattaaaatatgcagaaaagtgtaaataataaaacaatgaacacttttgcatttattgcctaactcaatacatttagaaaatcgcaatgcaattgaagccccctgtatgaacccccaatcacatcctactcctttccctctacatgttgccattatcttcaattcagtatttatcattcctctgcatgtcttttgattttcctacttatataaatatcacttgaaatatatgaaattattttgcttttttgaacattatatggtagaaatatatgcattcttctacaaacttgcttttttattgttcatcatggtatttgtaagactcattgatgaatgtaaaactcatgcatctatttataatcccgtataaaatcataattaaaagtctcactccattttttaatgtttgactgctgacagctttgaagtcttatctctccctcttctccctctgtcccacatctgggcaagataagaaagccaagatgctgcattccttaccaccagtgtaaagttcaaaccacaggtgagaatcctcattccagccccacccctaaccaccataaaaacccaagccaatcttctgtccttgctctatcaagccatttttggatgtgtctgagagccacccctgctctctgcagaaagcctcattatgtgagtaatcagcttttttatgaatattggtgtgtgtttgtttggtatcattggtgttgacatttaaaccaaattttgaactggagtccatcctgtccttgtggagtattcaaaaaattatttcagtgttcttttgttaatggatattaggttgtttccttttttttatagttgaaaacactgtttctatggatactttttattttttcttattgatttgtagaagttacatttatattctggatatggattccttgttagtgttgcaaatatctgctctcagtccgtagttagtctttttaccttaatggtttcttttgtagtacagaggtgatgaattttgatataaattttgatcaaatctaccagtctatttatgattgatctttgtatctttaagaaatatttctctgatttggagactataaaaatgctcttctaaatgttctaaaacctttaaagttgatttttcccatttaggactttgatctatttattttttgttgtataaattatttcctttcttgtaatgtctgtctggttttcgtatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttttaagctcagatattattatttacatctctaaaattttaatttgggcgtctttgttacagttttccatgcctctacttaactttgtaaatgaatagattatgtcataactttttaaatgtccttgtctggtaactctaacatctgcatcaattcttggttggtttcaatttattgatttttttttttttttattttgtaatttcaagcttctttgcattgctggtgatgtttgtttacattcaagccttgtggattttaccttgttggatgctagatatttttatataactaaaaatttcttgagctttattctggaatgtgataaaactacatggaaacagtttgatccttttatgtcttgcttttaagattgattaggtggaaccagggtggtgctcagtctacggaaaattattccttgctggctgttggtaacaggtgctgttcctgtctcagtgtaagtgatgaaaactgttctttctagtgatttcaaatggttctttcccctgccttgggtagttgcctctgtatacactaatgtgtactctgttttttttttttttgagatggagtctcgctctgtctcccaggctggagtgcagtggcacgatctcagctcactgcaacctctgcctcccgggttttacgccattctcctgcctcagcctcccgagtagctgggactacaggcatgcaccacctacgcccggctagttttttttgtatttttagtagagatgggggtttcaccatgttagccaggatggtctcgaactcctgatcttgtgatccgcccgcctcggcctcccaaagtgctgggattacaagtatgagccaccgcgcctggcaatgtatacgctgttgaatactcaatggagcctttgcagatctcaggagttctttttctgcactgtttccccattctgctaactattacctgcagattttagctgccttcttctcactggactctgagctttgtctccttacctcaggggatctgccaggttctgactcagttattacccttgcctgtggcatgatctgaaaattctctcagggaagtacgctggggcatttatagggtcaccttgtttctttaccatttctcaaggattattggccctcactacctgatatctattgttgtgagaataatttgctttttaatttttcaacaagttgggtaaatggtccctgttattccatcttgcccagaagtgcaagttcagctgagagtttaaaaagtgttaagattctcataagttttttatgtagggaatcttatcaactctaaatattaacaattccctttattcatttctaatccttactctcttctgctttctccttttccttcttcctcttacttcctcccacacctctggatagggccttcagtataatgaatgaaagggatgatagcagtgattcctgactcccattattaaagggggaacacatttctaatgtcattatttgttttttacaatgaagcctttgtgctcttctttcacatcagtttacaagtgctgtttgacaagaatttcctgtaagcccttaagttattgagtaacagtttagtgcttaagttaactgtcaaacaacatttattatatgccatctttcaaagtacttacctatattaacgcatgagaggcccaaaacaaacataagaggtaggtactgttattatccccacttcacatatgagagacggtgaggttaaatacatttcctaaggttgcacataataaatggtgaagctgagattcgagtctaagaaacctggcactagagcccaggctgcttctgcactgtatttctctgctcttaactaatatgagagtattaaatgcaattgtcagttggttcatttaaatgaccacaaagacatttctagcacttagtgttcacatttcaattatttatgccagccaagtaaccactatcaacaaaagttacaaacagtagatatttcactataggaaaagatgggagtaaaattgtagccctcttagcaggttggttttgaggaatttaacttactagattcaagttacgtgattcctgctatcccatgagttttgttggctgcaggccagggattggctgtttactactttccgctgtctcagtgctgtaataccctggcctaatggctctaattaactccatatatttgttccagaaagatgaagaggttctgtatagttaagaatcaataaaatacaaattgttgcttaggaaaccccgtgtactcttagtgtcagtaattaactttttttctggagaagtttaagaaacaggcccaagccattcaatagccatttgtgaagctgatatttaaagaaatgtagatgctgcattagaatctttaggcatctacaccaagaatgcagtgattccatcacaaaaatttcttttctttcctattggcagattataggaataaagtatttctgatttaactaactcaggtaccagggaatatttgggcaaattagtacatctcttgttttgttttttaaaattttttcataaaatccagatcctgcacaataataaatctcttaatttattagtagctgctttcttaaaaggatttatgaacataactttctgctttactaatacagagctgaagcagacttaggaccgatgagaagaatgtaaactaaaaatcatgtctttatgaaaataggaatttcttcctaagatctgggtgaggtttctcagtggcatacattgacctcagtggtcaggatacaaaactcacacagacgataaagctgacgaagtggaggaaattggcttgcaaacacttggagaaatcacttcaaagtaaaaccactttcaaattgctttttttttctgactatggaatagtgtttagcatgtttcagcaaaagtctgcacaacaatacactagatataaattttaaaagacaaatagcatcacagagcgacactcagggagagatctatttctgtagagtataagtggcttaagaacctaaatgtggatattttaaaattaaaaaaatcaaacctcttccactttggagattatttatgtgaaggtttcttatggccattcctctgccagagctctctagaagagcagagtgtttcttaattttattccagtcagattcactactattcgaacatttatcccaaatacttatactctcaatacttaaatttatctcaatctatcaagtctcactgcttctccttttctttttattctccacatatttaaagttactagtgtgtccacattagcagaattccttgtgtccaggaagatgtgtcttctgtgtactaaaaagcaatatcctcctgtcctatgtgtacagaaatggatccaggcagaaacctttgagtagtcaactgcatgagcagcttcagatccatgacaagtccttcccttcctgttccatacctgctcttttgttctaagagaaaactgttttataagaaaatatgtatgcttctgtctctattattatataaaattcagccttcctccatttctgccagaaaaaaatatgttctttaagcttgcatttttttctataatcttaataaaattttagaacttagccttaaaaattcaaggctcataattgacaaaatgagtcttcatgcctatagctgcaaagggatacatgccatcttgtattataaaaccaattccatgaatcttatttgatatagaaatcaatatgtctgcaaatatttttatctggttttcttttgctgcatggagatttgtgtgaatatacagaactgttaccaacctgtggtcttcttggttaatagaaatctgtccttcaaatttttcatgtcaacaaatggagtcctgtaagacaatggttctcaaaatgtggtccagggagccctgggtgtccatgtgaccctttcaaggccttttcaagattgaaactattttcaataacgctaatacattcgctttcaaaatttcattatcttgcagtgttacagtggattttaaaaagagactttctgttgtgagatatcataacagattgggtgaggaatcagatatgagaatttagttgtcagctattaagtcaaacattaaagagatttgcagaattgtaaatcagtgccactcttcccactatttgttttattttggaaaatacagttattcttcataagataggttatttatattaacatgtaatgagttttgttattatttaaaagtaagtgaataaatatttaaatttctaatacactaaatatggatagatagaacccacatgaaccaaggccttttggggtcctcaaaaaaattttttcggagtataaaaggctctgcaaaacaaaaagtttgagaaccgctgctcaagattccaaagacttttttttttaaattttattattattatattttaagttttagggtacatgtgcacaacgtgtagattagttacatatgtatacatgtgccatgttggtgtgctgcacccattaactcgtcatttagcattaggtatatctcctaatgctatccctccccccttcccccaccccacaacggtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttatagtcctttgagtatatacccagtaatgggatggctgggtcaaatggtatttctagttctagatccctgaggaattgccacactgacttccacaatggttgaactagtttacagtgccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtgttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtagggtgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaagttttcttctagggtttttatggttttaggtctaacatgtaagtctttaatccatcttgaattagtttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccgtgctgttttggttactgtagccttgtagtatagtttaaagtcaggtagcgtgatgcctccagctttattcttttggcttaggattgaattggcaatgcgggctcttttttggttccatatgaacttgaaagtagttttttccaattctgtgaagaaagtcaagattccaaagactttagaaactgttgccatgtcctctgagaaaagcttcagaagaaaaacctatagttctcattggttgtcttaattgatgatttgttaccctagtaataatgttgtaatgaacttacatgtattctcaaacagtgcagatacttttggtgttttcttctctacctcattcatggaggagcaaataaaaacttacaagcctgttagttttgtaatatatttgaagagcctttgtttatttagtttaacactgtactatgtgacacattaatagaagagtttccggtttgttggtgaggtagtcagtttttagtagtaggaaaagctttattttcaacattgtgatttggggactttgttgtttgaatgctttggtttgctccactttctcatgtcttttttctcaccttctacatgtagtatacttgctatagctttaagttccaattgcatatcttctttatgtaaaatgatataatcttgagtcctgctaagttaggtgggccaagggagaaaaggcaatgagcagaggccccaaaatgttaatggtgttcctatgagatgaggtcaggctatcagaagctcatacagctgtagacactttaaagacatcacttctctttattcttagtggattttatattttgagtatgatttgacgttcttttaatgtgccaacaatattagataccactttattaattaattatttataagatggggtatcactctgacacccaggctggggtgcagtggagtggtcttggctcactgcatcctccacctccgaggctcaagcgatcctcccacctcaactccctgagtagctgggaccacaggtgcgcaccaccatggctggctaattttttttttttttttatgtttggtaaaaatggggtttcaccatgttgcccaggctggtctctaactcctgagttcaagtgatccacccgcctcagcctcccagagttctgggattataggcatgtgccactacacccagctaggtgtcacattattaaacatgcttgaagtaataacttctggccttataaagagtttttataagtctccttttgagggctttattttcttggagaaggctttgttgccaatgtttgttgtcaattgaacacattaactgttgcttctcctttcttagacatgagccagggtgtgacttctcattctgcccctttccaggttcccagattgtttttgtggtaagctcaataatgtcccctaaaggtgttcacattctgaaccccagaacttgtcagtatgttaatttacatgttacaagggacttgcagatatgattaagactttgaaatgaggggattatcctggattattaggatgggcccaatgtgatacaagggtccttataagatggagacaggggaattagagttatagagtgaagatgtaagactgacaagtggtcagagaggagagaagatgctatcttgatggctttgaagatggaggaagggactgtgatcccaggaatggaaacagcctctagaaaatggaaaggaccagtaaatagcatctcacctagagcctccagaagaaacgaacctcactaacagcttaattttaaaccagggaagtaaatttttagactttttacctccagaattataagatgataaattcatattgttttagctactaagtttttggtaatttttttatattagcagtaagaaaccaacacagattttggtacctggaagtagagtgctgctgtaccaagcacctaaaaatgtggaagtggctttggaattgggtaatggttgagaatggaaaaattttgagaatacgtggaagaattttgagaatgattgaggatggagaattttgagaagtgtgatagaaaaagcctatatttctttgaattctttgaattgttagtagaaacatagatgttaaacattctaatagtgagggcccagaaggaagtgaggcacatatcagagaaaacctatattatcctaaagaaaatctgtatcagcttgttaaaaatacagacattaaaaaagcttcatgtgaaggcagatatgtagactttaaaggtattgctggtgacagcacagaaggaaataaggaacattttattgctcctctcttagatatgagccagcatgtgacttctccctctgcccctttccaggttcccaaattgtttctatggtaagttgaataatggccccctaaagatgttcacattctaatccccagaactgaagaaaagaagatccttactatatagtggcagaaagcttagctgaatgtggcttacagttttgtagtaagcagacattgtaagcaataagcttggatatttagctgagatttccaagcaaagtgttaaaagtatggctagcttcttctcgatgctcattaaaatgtgacaagaatgagagaaattgaaggaagaactgttaagcaaaaatgaactaggacttgatagtttgggaaattctcagcctatccagactgcaaatgatgttaaaatttggagattcacagtcaggaaagcttactatggagagaaagccaaagcaggcagtgtggcatcttctcttctctctgatctctgcagcatcttctcttctctctgatctcagtcacacacaaaggtgtgactggacagccttttgctactgccttggaagagggctttgtgaagagattaggcatgcatctcataaatcctctaagccaggaatagagatggaattatccaggatagatatctggaggaagtccttgtctaatggagtgaatactgagacatacacaagagacccacaaggcattttagaaggttgtagcagcagaaacactaccagcttggactgaaagggacagagagagaatggaatgaaagaaggctgttggacttctaaaattctacaggcagaagacaggctgataaaaatatttagcagtaggctgggcgtggtggcacatgcctgtaatcccagcgctttgggaggttgaggcaggaggaacacgaggtcaagagatcgagaccatcctggccaacacagtgaaaccccgtctctaccaaaaatacaaaaattagttgggcatggtggtgcgtgcctgtagtcccagctactcaggaggctgaggcaggagaatcgcttgaacgcaggagaatcgcttgaacccaggaggcggaggttgcagtgagcaaagatcacaccactgcactccagcctggcgacagagtgagactctgtctcaaaaacaagcaacaaaacaaaacaaacaaacaaaaaatttagctgtaaatacatgctaccttttatgaaaaagaatgactctgaaggtggaatgagcctgggtccagagggtagacccttgagccacagaggatatttttaggcctttagcctaatggagtatgactggttagattttaaaattgcttgggactggtagctctttttttctctttcgtttttctcccattttggatgggaatgcctgtaactatcaaactatgcctgtttcacctttgtattttgggagcagataattcgttttgcagtttaacaggtccactgatggaggtgaatttttccccaggatcctttatatctagagcctcacccatacctaaatgagatgacttacatgatgagatttgagacttttgagctgatgagacttacatgagattttggacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtttttgtcatgttgcccaggctggtcttgaattcctgagctcaagtgatccacacacctcagcctctcaaagcgctgggattacaggcatgagccaccgtgcccggcccgatgtgaatctttgggggccagagagtggactatcataggctgaataatggcctccaaagatgtccacattctaatccctgaaacttgtgaatatatgaccttacacgatgaaaagagactttgcagatatgattaagttaaggatagatattaaggtggggagattatcctgtattacccaatgtagtcgcaaagttccttataagggaggcaggagatttggagtcagaaagggaagatacaaggttggaagcagagatcagagagaagagaagatgctgcagtgcctactttgaagatggaagatggagccacgagccaaggaatgtaggtagactgtggaagctagaaactgcagggaactggattttccccaaaagcctccagaagtaatgctctgtattgacaccttaattttagcccagtgaaacagattttgcatttctgactatattagttcattctcgcactggtatagagaaatgcctgagactgggtaatttacaaagaaaagaggtttaattggctcacagttctgcaggctgtacaggaaacatagcagcttctgcttctggggaggcctcagaaaacttaacaatcatggcagaaggcatgtcttacgtggccggagcaggtggaagagagagagggggaaggtactatacacttttaaaacaaccagatcttgtgataactcattcactcattatcacaagaacagcaccaagtggatggtgctaaaccattcatgagaactccactctatgatccaaccacctcccatcaggccccacctccaacattggggattataattgaacatgagatttgggtgggaacagagatccaaaccgtatcagtgactttcacaactataagaaaatacatttgtattgttttaagcaactaagtttgtcataatttgttatagcagcaacaggatgattacaacttcttaaacaaacaaatatgtatctgtttaaaatgttgattatcaaatacatcaaacctatagaaaagaatcagaaaataacagggattcactatccagattaaaataaacattttaccacactttatttcaatgtcttgttaaaaagaaataaagtgtacaaatacaccttcagctcactctcatcccatttcccttgtttcctctgtaaaagtaaccattattctgagattggtatgtatccttttgggtcacgtttttggacatatacccctaaaatacatatagtattgttttctacgttctaaaatattgtataaatgctatcatactgtacctgttatttaactccttattcatcaacatgtttttagatttattgagttcatttttaactgctatatagtattgttgcagaattttgctccttagttcagctagaactgggttcttgtcacaagaccaggaaggattaggaacatggatacattgaagggtgaggggaatggaatttattgggtgaaaaggaaaaaaaaaaatcagcaaggggatcctgccagcagcaggctcccatctcacagattgaatgccaggccaccacacaggaaccgaagatgaagaggccaggctcctccccactgcaaagagtgaacttcccatggctccaccccattctcccagtgggcaaactagtcggagattctccgggggaccctcctcctatctctttctcctgcatttatcagtattacattttgtggtgtttatctttccattcctgatatgtcatataccaaatatggacatttacttgttgccagttttttcaatattacaatgctgaaatgagcattcttgtacaaatttcctgtgtacgtgtgcaagattttctctagaataggtatctagaagaggaattactgtatagtaagttatgtacatcttcagttagctagatgttgaaaaattgtggctgtgacactttaatttcaatttgtctccctatattttcagcactttgtattgttggacttttaaatttttgtcagtattatgggtgtgaaatggtatctaactttaatgtctcagataaactagggggatttgacatcttttcatatattgactggccattcttttttcatcttctgtgatttgccactttacatcctcttcctattgtgttgggtcttttttatatacctgcaagacttgttgttatatatttatatacaatggatatttatgttgattttacagtttataatatcttctagtctgcggcctgtcttttccatctgcttattgtgtattttaaccaagaccaccctcaggcttgatgatttgctagaaggattcacagaacttacaaaagctgttatactcatggttacaatttattaggatgtgtgacggtgcatgtgaagtgttgtcagccagggaagcatacctgaaccttggtgtcccgggcttttaaaattgggaatcagtcacataagaatgcagcacttgcatgactagccttagttactgagactacagcctcccctcacccataaagcacaaaaacaggcacttaccacaaatcacagcatttgcacaaactatctgatcataatggtactgtatggcccaaggcctcaggcatatgaaaacaacgtgaagcaaaatatgccggtggcttgagaactcatctcccaggaattgggcaagggccagccactcctggagacaggactttcctgagaatttgcagggtttgggggtttttgagttaaccctttcctgcacaggaggtatatattttaatagtcacatttatcttccttttccttcatgttgtactttttctgttttttatttcttttttttctctttttttttcttgcttccagtgggattaagatcttttctgttttttttttcatctcgtttaaggaattcttccttaccttgatgtcataaagatattctactataaattctcatgtaaaattttatagtttccttttcacaatttagctctgtggtccacttggaatttctttttgtagaaaagaaattctattagaagaatgtagggatgtaaggatcttacttaatttttttctgaatgattaatgagtggttccaggactattaattattctgttatttctgcacagatttataatgttatctcagtcgtataccaatttcctatatatatgtgtgtctgcttctaggctttctattctgttccattggttcgtttgtctatttctgtagctttataatgcatcttaatatttggtagggaaaggcctcttattcctctccctcaaaaatatgttcttttcatatgagtttaaggtcagcttactttaaatcttaaggtctgtaagaaacattgagatttgattagagctgcattttgtttatagattagagacagaactggcatctttacaaaaatgaaggtggttcatctctccctttatataggtgtttttcattattttgagaaagttttataagtttttttataagtatctaattcatagtttgctagatatatttttgtgtgcctattgctctcatgaatatttctaaattacattttgttattggttgtgccaggtgtataggaatgcttgattctggtatattgttgttaaatccatccaccttgctgacctctctctctaagtccaattatttgtttatatattttgctagggttttatataaatattatataaaacatgcttaaaagtacatgaaccataactatagagctaaatgaaatgtcacaaagtgtttttggtttatttatgtaatttgtgaataatttttttcccttttccttataccgccagaatttgatgtctttctatgtaaaataaaatagaatttcttttctgaaataatctctttttttttagacagagtcttgctctgtcgcccaggctggagtgcagtggcatgatctcggctcactgcaacctctgcctctgaggttcaagcaattcccctgcctagctgggactacaggtgcgcaacaccacgcctgtttaactttttatatttttagtagagatggggttttgccatgttggccaggctggtctcaaactcctggcctcaagtgatctgcccacctcgacctcccaaagtgctgggattacagacgtgaggcactgcgcccggcctgaaacaattttatttaagcacctgaggaggctcacgctctagtgagctgtgttggatgtgtcaatgcttttcaacttatcaaagaaaggaaattaccagtatttggaaattccaacagaacttaacaaaagggcctacagagtggtgatttcagttagttgaccacagtccaggatttggttctgagcatttgtgaaatgttgaaacaagacttggtggtaaacaaatacaaattaatttactgagactaacatagatacgggtacagagagaaaaacacacacatcatactaatgtattatttccactggtcaacacactcaggccttttatccagggcatgtcagtttcagtattgaggtacatgggaagtcaaactaagaaaacaaaatgctggctgggcgcagtggctcacacctttaataccagcactttgggaggccaaggcaggcacatcacctgaggtcaggagtttgagaccagcctggccaacatgatgaaaccctgtctctaccaaaaatacaaaaaattagccaggcatggtggcaggtgcctgtaatcccagctactcgggaggctgaggtaggagatttgcttgaacccgggaggtggaggttgcagtgagctgagatggtgccattgcactccagcctgggcgacaagagtgaaactccatctcaaaaacaaacaaacaaaaaaaagagaaagcaaaattctgtttactgtgacctagcactaaagcaaaggaaagtaaggaatcttgtaaacgtggaatcctttgtattaaggaatatattcagttactctgccttctctttatcacaccccaagcagtttgagaggcagcaagatgcagtggaaaagtactgggtttgataactgattgacagggatttgaatcctagctctttgtggatggaccttaggcaagttactgcacttaacttctcagagtttccattttctcactgttgaaatagaaatcatgacattgttaatttaaaagaaatacagcatctcaaagtaattattatagagtaaatccagcagaatcacaggcttgcatttgcttatccaggcctgtgagtaaagaagaaagtgccagtcaatgattatgcctaatttgccggaataaatcctagtaccagtctgtttccaagtacaagtagtccccgcttatcctccagggatacattccaagaccttcagtggatgcctgaaactgttgacagtactgaaccctatacatacactgtttttttcctatacataatgtacctgtaaattaggcacagttaacaacaataactaataatgaaatagaaagattataacaatagactgtaataacagttatggtaatgtggtctctttctctcttttctctcaaaatatcttattgcaccatacttaccttcttgtgatgttgagagatgataacctagccagctactagatgactcatagacagggagcatctatagcacagatacgctagacaaagggaggattcatggcccaggtggtacagccagagatttcatcatgctattcaggacagtgtgcaatttagaatatatgaattgtttatttctggaatttcccatttaatatttttggactgtagtttactgcaggtaactgaaactgcagaaagtgaaaccacagataagggggtactgctgtatagagatggcaactacaactttactaccagatgtattagtttcctattactgctgtagtaaattatgacaaacgtagtttaaaccacacacttttaatgttacaattctggaggttagtggtcctaaaatcaaggtgttggcagggctacccttcccttagggaccgctagaaaataatctgtcttcttgctttttccagtttctaaaggccacctaccttccttggctcctgctccctttctccatcttcagacataacagcaaagcattttcagctctctgactctgacctgctcccgttgccatctctcctctgactctgatcctcctgcctccttataaggatcccagtaattacactgggctcaccaagataatccaggataatctcttcatctcagaatcttaactcagtcacatctgcaaagcccatttgccatgtaaggtaacatcttcacaagggttgggatttgaacatcttgggaggaccattattctgcttaccacaccaggttaatgaattaccaagtaaaatacctaattagaattacacatctcttttgtaggttattttcactgaaacaggcattaatttctaaagttgtaggagtcataaaatggctttatttagacaatacttccaaggaaagatttgtattaacagagaatagaactagttggtaacagttacaaatattctcaaatcaccatattgcaaaggggaacaagatttacattcttgttaaagttctcaatttaatgcctttttaaattcagattatttgaaattattgtgcagcaaaatggtttccacgcctccacagcagcaggggagcgggcacagagccttcatatctttctgagtttccttttgttaattctgaagatttgcatttgtaaagctaggctctggaatttcttagctagttttaaataaaaaacatgtctgggtcctcgttatgctggcagaaatggagaaaaagctgaaaggattttattaccaatgaaattctatattttgtgccttgtaaagtagttgtgaagatttaatgtgaccacttacaagccctgactactgcttgatgaatgagagcagtttgagtctcttaccttcttttttgtactttccgcccttttgtatcttcctgctgagctcagataatttcgtcttacctgtctttaaatttaaattctctacttaatcttctaattaaagctatcccttgagtttttaattttgagtactgtattttttttctaaatgtttgattaggttcaattatggtctgccatttgttatggcttcctgttgcttggtaagatcttcaagttttttatttatctctttatgcatagtaaacatagtcgtcttatagtttgtgtttgataatcctattgtttaaagtctttttgtgaacatttctgttgtcagctgatcctgctgatttgcttctttatctaattcaaggctcaaggttcccagggcaagttatgtgatccaaatctgagctgcaaaactggcctgcttccattcaccctcccctttagggggtagccctttgaggtcccagctcattgttgggaatgtctcctcttagttttcccacttagtgtagctctgggttttaatctcttatctcttttgcctttcaaggcagccaaaatgaaagctgaaatttttggaatagacaaatgcccttaggacagaagttgcttcactgctctatttacctctaggttccccatttcccaggaatgttgccctagtgtttccatactgccattttattgtttttaagtaggtgttactacttttctttcatcaagatttttaaaatttgttttcaacctgatgattggtccaaataatgtggcaggcaatcatcagaactagaaacatttcttataactccttgctacattttctttgagattagatttaggctcagaacttcattatcttttgggttttgtttcttctgttttatagaggacacatctgatgctcagaaaagtacaaatacttgctcaaggtcacatagcaagtaagtggtaatattgggctttgaacccagctctgtccaaccctgaaacctacactgtgtcagtttttgttcctgggttctggaacttctttcttttaggaagcaggtaaatgactcgtgattttcttccttgagttttatctctcaaggtcaagaccatctatctccctgtctcttggaagcacacacagttctgtgcttttttcacaaggtccttgtcctgtttctaagacgtcctgataaataagtatccctttctaccacccaccttgtacctttcagaactgaattcagggacattcagtatccaactgtaaccataaagtttgatttccttttcaactgcagtattttcctcaaaagacctagatgaattccctgctgaatttggaaagagctaaggacaaagtgacccgggaagcaatccttttagatgaaaggaggagggagaatgatacaagtaggggttagagaacttacagtttagttgtatagtggtgggatagttgaagattttggattggtgaatgcccacaaggcaccttgtcatggtgacaaatacaggagctttggagccagacccacttcagctgaatatcagttcacctacatattaactctaaaatgttgggcaagtcagcttccctctcttgaccatcagtttcttcatccacaaacttggaataataatagcaaactttcaaggtttccgtgtgaaataccaatgatgtatttcagtgaagtgtttgtgtttggtgcatgcttactaaatggttgtggtagttattattattgttgtccccctcaaacttttcatctggtgggtgccctaagaccaggcaggagagttcatttttcatttgtgtgtatgcccagttactcctctctcctctgttgcatcatcttcttcagtctcctgaagatctcttaccgtctacgttcttcccaatccttgctttcctctcctagttctacacagtcaacacctcctttgttcagataatcttcccatttccctactcaatttaatctcttttcattgcctctgcattgtcctccagataaaccagtcatcctcatatcactttgtttcttcatgtccctctctccctgatttgggaggccaccccaaagtgagacatatcactgggtctcagcaggccttaatttctcagctgattctctgtcttattttgtcagcttcttttcattaagtaaaagttatgtttttctgtgtattattttttaagctgtttagttatggatatcttccttttttacgtattttacattataaaagtagagacatgctcattttgaagattttagagaacaacaaaactttattaggaaggaaataaaagtgacccacagttttattaactagagataaatactattcagtaattgatatatttcttttcagtatatacagttttgtatcatttgctaggactgtgtaccacagtctgggtggcttaaacaatagaaatttattttttcccaattctggaggctagacgtctgagatcaaggtgctggcagggttggtttcttctcaggcctctctccttggcatgtagatggccgtcttctccttcctgtgtcctcacatggttttccttctctgtatatctctgtctttatctcctcttctttttattttatttttgcaattctcctgcctcagtctcctgagtagctgggattgcaggtgcccaccaccatgcccggctaatttttgtgtttttagtagagacgggttttcaccatgttggccaggctggtctcaaactcctgacctcaaatgatctgcccgcctcggcctcccaaagtgctaggattacaggcatgagcccccgcaccgggcttatctcctcttcttataaggacaccaggcatgttggattagaactctaatgatgtcattttaatttaactacctaactagacactaatgatgtcatttttaatttaactacctttttaaagatcttgtctccagtgtagtcacgttctgaggtactaggggttgggacttcaccgtatgaattttgaggggacacagttcagcccataacacctgctttcttctctaaaagttatcttttaagaattcccacttgtcgataacaattctttgacaatagttctgatgactacataatatcccatcattaaaatataccacaatttacttaatcaatttcatattcttggacctttcaggtgttttcattttttcactaatataaatgcttccataagtagttttgtacatggatgtttggatatctgactatttgtttggaatagattgcttgaagagtgattattgggtcaaaaggtatgactattctctggtttttaattacatactgcaaaattgttttccagaaaattgtactaatttacattcataccaggaaggagaatagtcagttaggcattcatataagctgctggtgggaatgagaaaggaaaaataaactctcatggttgtttcactttacattaattgatgactaacaaaatggaatatttcatgtatttattaatctgtttgcatttccttttttgtgaactgttactcatgttctttgcccatttatgtatgtgagtctatcattttaggtgataagattatgatttagagtgagttctactctaaagagggaaatttcagaaaaagtgaaattccaaagaatgttatggatccagaatccaaggactattggtctgagtctcttctttggagaagacttggcatgtgatgacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagtttatactggacagaatccctatgagtgtactgactgtgggaaaggcctcaagacaaactcagactgttttttttaacatgagagaattcatagtggagaacaaccctatgctcataatgcatgtggaaaggctttcagatccagctcagactttactaaacatgagagaattcatagtggaaagtaaccttatgcaatgatgaatgtgggaaagggtatctggagataacagaccttcaaaaacattagaaaatttatagcggagatggaaagagatcctttcagtgtaatgaatatggaaatgtttttaatctagagctcaaattttatttgtcatcaaagataatcttttacaatgaatatacaaaaacctccaaacagaaatcaatccttgttcatcatctgcagattcatagtggacagacactctgtacctgtaatgaataagccttcaattagaggctaagtcttattcattatcagaggattcataaaggcatcaccttctatgtacgtaaaaaattatgggtatgctttcagcaggatatcagccttatttgatattggcaagtctatagcgagttcgcttaaatgcagtgagtgtggaaaggccttcaatctgaagtttaatcttactcagcatcagaaaatacagagtggcaggaatcttattaatgtaatgtgtgtgggaaagtctttatgagaaaatcacgtcttggtaaaaatgaaaaaaagattctttgtaaaagttaaaatagttaccacataattacacgcctgccagtgtgccaagcactacaagaactttacattgtttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcaggattcactcttcagtgagtattgggagccttcagtcagttttggaattagagactctacattgggttctatcaaatttagtaaggactataaagactttatcatatttatattatccctttgaatagggattacttccaatcttgaaagatttcattaataacaaaattctgttctcaaatgctcaccctaaccactttctgtggtgtagacaacgtggagtgggatggaaagcacaggctctgggattggccaggatagcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatccttataagagagaggcaggaggaccagacttatagagagagaatgtgaggactaaaggagaggtcagagagggaagaagatgctatgctgctggctttgaatttggagaaaggagccatgaacaaagaactgcctgggaggcagaggttgcagtgagctgagatcatgcaactgcactccaacctgggcaacagagtgagattctgtctcaaaaaagaaagaaagaaagaaagatcctgtgggtaggagtgtgatggatagccgggtgcattggctcacatctgtaatcccagcactttggaaggccgaggcgggcagatcatttgaggtcaggagttccagaccatcctggccaacactgtgaaaccctgtctctactacaaatacaaaattagccaggcatggtggtgcacatctgtagtcccagctacttgggaggctgaggcaggagaatcgcttgaacctgggagggggaggttgcagtgagctgagatcacgccactgcactccagcctgagtgacagagtgagactccgtctcaaaaagaaaagaaaaaaaggagtgtgatggatagattggaaaagagaactgggtgcagggagaccagttaggaggctatttataaagtagatactgaaatctgggttaaggcagtgggaatgaaatgagaataccatatatgcaataaatttggaacttggtcactgactagatatagggggactgacggagaagaaggaatcaaggatgatgcccagttgtctttctgccttggatggttaacaagttgcaaaaaccattcatggagaactcagaataaggagcaggtttgtggggaaagaatgacctttgcagtgtccaagaggaattattcagtaggtagtccggaattcattctgctgctgtgaagcaagtagggttacagatagaaatcagatagaaatttggtagtcatcaaatacagaagtggtggttttaattgaagtatcaatgagattgccccgggagagggtggtgtggagtgagaaaaaaaaaagacccaaggcagaatctcagaaacctaggcattttgagggaagacaaagctgagaatcagcagaagaaaggtaggagggggaccagaggagatacagcattcttgttctgccctcttgtggcaagctgagtgtgtcccagcataaatcttccctctcttgtcttcagtcttccaggtctctgactcataattccattcccaccctacctgggagaatggagctgccaggtcttctcatggtcatttctcaaatgtaaagctcctcttcgattatttctacaattcaagagcaatttggaccccacccccatgttgcaaaagaataaaaagcaaacagtggggcggggcttcagtttccacatttatatgctccaccatcttttgatctattctattggcctcattaattttagtacatctcaactctcatcatatcccttcgctccctttataattaaaagacattttattttgaatttttttattatagtaaatatactgtatattatagcaagacctatgtatggcttaaaaaagaaataacaaaaaatagcagtattagcttcactttttttcaccaccagacttgaacacttgaaggctagaatgcaaattagccaactttgaaatctacttcttttggtttttatctaaataccattatttcatgagttacctatttcagatattagctgttgacttcccattatggtagatgaagatttaattcactttttctccctcaattaccttctctattcttttagtatagctatagcatactttctggttaatgatgtttatactattgtgattgtgcaaacattgttcactaaagagacaggtagtgaattgtgtctatgtttctgttttgaacacatttgtatcatttctagagttataattcccttttatctgtgtatttttatatatttatatttgaggcagagtcttgccctgtcacccaggctatagtgcaatagtgcgatcttggctcactgcaacctctgcctcctgggttcaagcaattttcctgcctcagcctccaggcagctgggattacaggcgcccaccatatctggctaatttttttgtatttttagtagagatgggggttcaccatgttggccaggctggtttcgaactcctgacctcaagtgatctgctcgccttggcctcccaaaatatccttattttttctgttagctctatcatatgtctatttttgtgtaactgctaaaaaacgtcagagtattcagaatatttattttctagaaatcccctttgtagagccttctctcttgatccagtctgggctgttttcaatcctgaaagcttttgggatttccactttatccctaatattctaaactttcatgatgatgtgtggatatttgtatatctgttgtcctagatacctggtaggtagactctttcagtttgtatgtttttgtacttggactctggaaagttttattatttcttggatactttgtgagctccataaggacacatttttatctattttatttatttctgtttttccagtgcctaaaatagtgcctgatacatgatagacatttatttgttgaatgaattactatttacatttaaaataataaaaatgaaataatgcctccagacccaccgaccaggacaagaaatagaacattatcagtactttagtgccctatccaatcacaccttcctgtccgcctccacctagagataatactaccctgatttttgtattaacaatttctttggttttcgtatatttttatcacttgtatatatgtttttaaacaacatattgtttagttttgaaaaaatggaaaagcgaacacaaacctagttgtacgagaaaagggtactgttgcccctgttagatagtctcccaggaaaacagaggttctgcgtcaaaaactgattttagcttctctgagaactgtaaagccatttctgggataattagtgaatgaggtcatgaaatttactgttactgatgaaagtcctatctgtctaatttaatttttctattgcaggtgacattttctctcttttcagctctcagagttatagttgacaaaaattatacgtattcaaggtgtatacatattcaaagtgatattttgatataaatatacattgggaaatgatttctacagtcaagctaattaacatatccatcaactcacagttaccttttttgtgggaatacttaagatctactctcttaatgaatttcaagtatgtaatacattattactaactatattcaccatgctgtacattagatctccagaacttactcatcttacaaccacaagtttgtatcctttgaccatctctccacttcccccacacactggctgaccttgggtaaccacccatccactctctgtttctatgagttcaactttttaaagattcagcatataagtgagatgatgcagtatttgtctttccgtgtttggcttatatcacttagcatagtgtcctccaggttcatctgtgttgttgcaaatggcaggatttcctttatcaagggtgaacaatattccattgtgtgtgtgtatgtatgtgtgtgtgtgtatacacacaatttcttaatgcatctgttgcagacacttagattgttttcatattgtaactattgctaaaaatgcagcaatgaacaggggagttcagatgcttctttaagatagtgattttatctcctttggatatacacccagaagtggaattgctggatcatatgttcaattcttaattttgggggggaacctccatactgtttctgctagtgactgtaccactttatactctcaccaacaatgtataaaggttcactttttgccactttttgccaacacttgttatcatttgactttttgataataactatcataacaagtgtgagatgttatctcattgtggttttaatttgcatttccttgaagattagaaatgtttaacactttcaatatacctgttgggcatttgtatgtcttccttggaaaaaatgtctattcaggtcctttgcccatttttaaattgggttatttgtgtgtgtttttttttaactactgagttaactatgtgagttccttatatattttgtatattaaccccttatcagatatatggtttgtgtatattttctcctaatctgtgggttgccttttcattttgttgattgtttcccttgctgtgtagaaactttgtagtttgatgtagtcccacttgtttatgtttgcttttgttacctgcctttttggtgtaataacaaaaaaatcattgtcatgttcaatgtgaaggaccttttccgatgttttcttctagaagttgtatgttttaggacttgcatttaaatctctaatccaatttccaatttgagttgaggggtgtgagagagagagagagagagtgtgtgtgtgtgtgtgtgtgtgtgtaagataatgatccaatttcatttttttctgcaatggacattcagtttttccaacaccatttgttgaagaaactatcctttccacattatgtattcttgatgcctttgtcaaagattagttgactgtatatgcatggatttgtttctgggctattttatttatttgtctatgtgtctgtttttatgccagtaccatgttgttttgattactatagctttgtaacgtaatgtgaaatcaggaagtatgatgcctctgactttgttcttcttattcaagattgcttttagttattaataggggttttattgaatctgcagattgctttagttagtacggacattttgacaatattgattcttccaatccatgaacacagaatacttttcaatttatttgtgtctttttcaatttcttccattattgttttgtagttttcagtgtacagatcttttacctccttggttaaatttattcctaagtattttattggttttgatgttattataaatgggattattttcttaatttcccttttggattatttattgttagtacatagaaatattattgatttttctatgctgatagtatattatgtaacttaattcatttattagttctaatagtttgttttatggagtccttaggtttttctgtatatacgattatgtcatctgcaaacagatataatttcacttcttcctttccaatttggatgcattttatttccttttcttgactaattgctctggttagggcctccagtactatgatgaatagaaatggtgagagtgggcatccttgtcttgttcatgatcttagaggaaaagcttacaacttttcaacattgagtatgttgttagccatgggcttgtgatatacggcctttactgcctttgggtacattcctcttatacctaatttgttgagagtttttatcattgaagatttctaaattttgtttctctttctctttaagattgtaattttttttcttgtttccttgaattcaagaatttaatcagggtatcctgagtatatcttagaatgtaagctccacaaagacagggatttttgtctgttttgttcactgatatatcccaagtgcctagaataatgctggctatgtaataagtcctcattagatgagttgattaaattaatgtatgaatgcataaattgatgaatggatggatgaacaggtactcaatcttgtctggaattcaggtagccctttctttagctcagggaaattttcttctatcatttagttaaatattgcctttcttccttctatttcttttctcctttaactccccatccatctcccatattcacattttaggttcattgacactatcctctagataccttgtcttgtatctcattgtatctattgctttttgggtttttttgctcagtgccttgatataaatcttgcacttaattttctagtcaagtaattcagggctcatcattgacatcatttttcattttattgtttaattggaatttgatacagtttggatttgtgtccccacctaaatctcatgttgaattgtgatccctaatttgggagagaggcctggtgggaggtaattggatcaagagggcagatttcccccttgctgttctcatgatagtgagttctcacgagatctggttgtttaaaagtgtgtagcacctccacccttctctctcttcctcctgctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatgatttcattgatccattgtgtggagctgtgagggatcaataaataacattcatctttcctgactaggttcagaaccaattgaaattgaaagatgtaggaatccgataaatggaactcaaaacatcatctttattactgataacacttcagagaatatggctttaatgtggacttcctaatattggaccccagaattaagcagatttacctaaaccaccataagcaatggtgaaaaaccacaagactctgggccaaaagtgggccacttgatgcatgatatgttttctgtaagcatgtagatgaagggcagagagcaagagcctaagccaagctgtattagtcagggttctctagagggacagaactatatatacacataaaaataaaggggagcttattaagtattaacttacacgatcacaaggtctcacaataggctatcggcaagctgaggagcaagaagagccaatccgagtcccaaaactgaagaacttggagtctgatgttcaagggcaggaagcatccagcacgagagaaagatgtaggctgggaggctaggtcagtctctccttctcacgtttttctgcctgctttatattcgctggcagctgattagattgtgcccaccagttgaagggtatatctgccttccccagcccgctgactcaaatgttaatctcttttggcaacaccctcacagacacacccaggatcaatactttgtatccttcaattcaatcaagttgatactcagtattaaccatcacacaagcatactcagatgtttcttccaaacatactagtcacataactcattccttcttctgtggacagaaaagcaggagtgttagtctatttgaagttcttccacttagaaacatgagaagtaaagattaagtgttccctctaacatagctcagtgatgtattcagtattgccatgtgcttgaacttgtctatctcttcaggaccaaaaatatcataattttgctgtgacacgaaaggtattaggatattttaggaagactgtagtacaaatagctcaattacagaatatcatgttaatgacatatcaatagaatatttaaaactccatctaaatgctataacaaaacatgaagaaatgcttcttaaaggcagatgtaccaaaaggaatccattcaccactctctaccaatgggaacatcaaacattgtacctttagagcatggtatatttctccacttaacacctactagaactctgcagtgaggcttcaagtgagaaacttctctgttatatctgggttgatgtaagatccacatatcaggaaagtaagtgtgtgtgtgtgtttgtgtgtgtgtgtgtatgagagaataagataggagtgggggacaagaagggagaggagaggaaataaaagaaggaaaatgagatatcagggaatgagcaccacaagtgtaaaatcctaagtgatgtgggtcatgtgtttgatggagagatagggagagagtattgtgtggtagtggggtagtggaggtatgtggccaaggtatgtgtgataatggtgtcaatggggacagtgtaaggatggtatgaaatcactgtgatcatgaagacagaggcaatgtgagtgacagtaacaggaagagatcagaatgtatgtgacagttgtagttatggtcacagtgtatgtgaaagacaagaattgtgcatgtgtgtgaatatggttgtgtgagaaagtggggagggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagaccggtgtggtggcgggtacctgtggtcccagtgcctgggaggctgaggcgggagaattgcttgaacccaggaggcggagattgcagtgagccgagatcgtgccactgaactccagcctgggtgacagagtgagaccctgtctcaaaatgaaacaaaacaaaaagagacggagtcttgccctggcgcccaggctggggtgcagtggtgctatcatagctcactgcagcctaaactcctggggtcaggggatccttctgcctcagcctcctgagtagctgagactaggagggtgagccaccgtgctgggctaggatctccatttttagacactttatctcagtgtattcaaaatatggttcttggacaagtgtgggttggtgatctggtctgccatgaactgagcctaagtgtttggcaaattttactgcaattttagagtgattttatttatgttgaatcaataatttaaaaagtgaggcttgtattttgtattctataatttactgtaatatcattttttctagaaacagactcttatttcacaaaagtattggttgaaacgaattaaagtgaacaaaaaaccaactggttttgcacaagtagtttgaaatatattgctctatcttactcaaaattgatgcgtatgtgatttctttttctataatgtgaagttttttttgttgttgttctttggggatcttgtgctctactcctaaaatattaatgtcatgcaggattccagaattgttttgttttgttccagatatttgccttgcgtatataaagatgtggtcattctttgcatgctctttccccagagacacatgtaaatggagttgtaatttcctgttggtaaacagcaagtatttaaatttagaatcaggtggtaaggttgatatgtagaagggtaatacattggattgccttcaaagtgatatcttttccagttaactgttaactcactaatttactgtttttcttttctttcttatgcttcatgaatttatgtgtcatctgtacaggggccatgtgctaatctctgcacggttccaattttagtgtttgtgctgccaaagcaagcacggcttttcttaatcctatcaaatattacatggtatgttaaaacagtatagatctggcttaaggtatttcatggatgacaaatggacctcatgttatagaggaatgaaagatataaattaataaaacatgatcatgataagaataaaaccaaactaaatctcctctccagtgcttggcagcacactcccggagagggttcaggctgtatgtggccccccagcaggtgctcagagatggcttaatggcctcggtgacaacaggagcccagactgcataagactctgcctctgcagatgcagaacagtaggggcctctgatgtgcttgaacatctgttttggatctccatttctcctcaagaagagactcctttttaaaaattattttttttgaagctgcattacttactgatttccagagtcgttttacacctgcccttctcaagggaatattttgggcataatcttttttttttttttaattatactaagttatagggtacatgtgcacaacgtgcaggtttgttacttatgtatacatgtgccatgttggtgtgctgcacccattaactcgtcatttacattaggtatatctcctaatgctatccctccccccttcccccaccccacaacaggccctggtgtgtgatgttccccttcctgtgtccaagtgttctcattgttcagttcccacctatgagtgagaatatgcggtgtttggttttttgtccttgcaatagtttgctgagaatgatggtgtccagcttcatccatgtccctacaaaggacatgaactcatcattttttatggctgcatagtattccatggtgtatatgtgccacattgtcttaatccagtctatcattgatggacatttgggttggttccaagtctttgctattgtgaatagtgccacaataaacatacatgtgcatgtgtctttatagcagcatgatttatggaatcctttgagtatatacctagtaatgggatggctgggtcaaatggtatttctagttctagatccctgaggaatcgccacaccgacttctacagtggttgaactagtttccagtgccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcatttttttaatgtgttttttggctgcataaatgtcttcctttgaaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctggtggtagtttcttttgctgtgcagaagctctttagtttaattagatcccatttgtcaattttggcttttgttgccattgcttttggtgttttagacatgaagtccttgttgggcataatcttttaatctttctggaaagctaacaaaacattatctatgccaggctttccaccaggcacaccccattctttccatcacagtgctttttaaaggactttatcatttgttctctgggttcatttaactcttaacttacaccgatttagcatctttgctatatttcctttcttatttcattctttatatgttatgttacatttctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaataaaaaaataaaaagaaagagggtttaattgactcacagttctgcatggcttgggagggctcaggaaacttacaatcttggtggaaggggaagaggcacatcttgcatggcagcaggtgaaagagagtgagcaagagtagggaaaactgccttataaaaccatcagatctcatgagcactcactatcatgagaacagggtaagggaaaatgactccatgatccagtcacctcccaccgggtccctcccttgacatgtggggattatgaggattacaatttgagatgggatttgggtggggacacagagccaaaccatatcagcaggattgaaaggtaaagtgtgaatatgatagtttggagaactgggacaatatgtggagataatacttataagtcatagtcatgatcatgagtcagagagagtcatgtgaatgagatagtgtgttagactgtgtgtgtgtgtgtgtgtgtgagagagagagagagagagagagagaagttggggtaggggcatgtcatgttttaggatgggtatttggaatatcatttggatatgagtaacaaggacctaaaaatgagttgcttaaaataattaggggatatcttttccttacctgaaacaagcccaggacctccacaattttatcaatgtctcagtccccttatatatttttttgttccttggtccttggtatatagctctcatcttccaggtaccttctggttgaaggatgcctgctgcaactctggccatcatttctatgtttcaggtagaaagaatgaggaagaggagagggcaaaaataccttgtcagtggaattagtctccttatacagagctttcccaaaaatcctatccagttactgccaaatacatctcatgggaaagaactgtgacacatagccaccactatctgtagctgagagaacatggtaagaaaaaacagtttcttagtaaggaaaaggagatgttggtaggatatcaccagtagagaaggagaggttgaagatttgcgagagggagtataattaatagatgaaaatcacgatggtgctagatacagatgggatatgactggcagagtttgagatgctggaggatatcatggtaagcaaaaatagacatattgtctctgccctcatgaagctactgtcttgtgaagaagacagtaatcgcagactcaaatatttgtgaagttgtcactctggtaagtgctatggaggggaagtacatggttctgtgaataggttaaaagagggctttacctaatcagggaagtaaaagcagggaggaagtaatgatggagatgaaaccagaagacagattcagaattgattggttgaaggatctgtggatgggatggggtaaaagtgtttccagaagaggaaacagcatgaacaaagggacttatgctctgttgtcttttaaaatgtattttatttcacttagaatcttttccattatgtcttcaagttcactaatctttagtaattaatatcatctagcatttttttcttctcaaatattacagtttttatatctagatatatgacttggaccttattaaatagatctcatgtttttacttaacatgaccattctttcctctaagtttttggacacatggaaatagttataatggcttttaatgtgcttatctgctaattataacatctattaaatatttaagttctgggtaagtttggattgattgatttttctcctcaagatgggtcctatttttctgcttcttggtatgcctggtttttttttaattcgatgccaggcaatgtaaattttacctttcggtaaaattttggtgaaattttttcttttggtgctagatatttttatattcctacaaagctacctgagctttgttctgaaatgcacttctttggaaacagttagatctttttgagtcttgcttttatgatttgttaggcaggaccacagcagttttttgcataaagctaattatccctgactgatgaggcaagacccctctgagtatcccatgccaatgaattaggaagttttccactttagctggtgagaacagcatggtccccagacctgttggagcttctggcacttgttccctttaatcctttcaggtgactctttccccagcctcaggcaatttccttttatgaattcactgatcagtactctgtcaaatacttaatggcaatccttcaaagatctccagtgttctccctgtgtaactctctctttttgggtactctgctctgtgaactctagctaccttggtctttctggtctctcatctctgtcactccaattcaaggaatcccctggattctgactacattctcccttgttgctccacaaactggaacctctcaagcagtaagtgctcacttcttttttcctcatctctcagggattactcttcttcattgcctaatgttcagtgtcttcaaaaaccattatttcatattttatgtccatttttaagtgttttttgtcaggttggagggcaaaatcctgtctccagcttgcctcttaggaagttatatggtggagacctgttagataattattttcttttcttttacagttgtttgaccttctcactactgccaagtatcacaaatgagtgacagttataatttttttatcaaatgagaaaagcctgagaataagaaatgtattcaaaatcagggatttgaggaacaatttgggtcacaggggaatgtggccatatattacaaggataactcctcatgactctaaccacaaggaacttctgagcataaagacaagttagaaaaggagattaaccttctttcaaaggatagatgtttaaggcttggggtagatattcacaggattggttcccagccagggggcttccaagactatagtaagtgttagagtaattgtgctctaatctcagacatcctacgggaggatgaaaccatacataggacaaacccacacccacacccatagtgtgggtcacatgaccatagcttcagaccaatttcagagactataaatcagcacgaaaaggccatgatggtgagaaaatgtgtgaagagcattgaagagcctttggccaagcttcagatcttattaacatcaaataattcattagcagagataaactctatgaatgtagtgatcatggatggtctttctttctttttttttttttcttttcacattcagttgactttgtggatggtctttcaaccagagttcaaatgtcattcattattgttaaacacatactgaagccatagaaatgcagtcagtggaaaaaagccttcaggaacaaatcaaacctgagtaatcatgagaaatttcaacctggagagaaactgttgaatatacaaaatgtgatactccactctgttcttatcccatgcagactcccccaatctgtgtaagtgattcctttggatccctcctcacatggctttggtgagggagttgcatgcccctctccttcctcaagaaaaaggaaaacactcttccccaagccaaggactcacaacactgtaaattcttatctaattctttctagctttctgagtacatatgggctgaaaaggaatggaatgaataccagtagcatgactagtatgctctccccatgtaaggcccgtaggattgtgttcagatctcctgggatgttctttttagaatgtggaggcactgggtacctttttcttttcttttcttttcttttctttttaaaggctatatggctttaaccaaaattctgaggaaagtgtgaaagttccattcaataacctgctaaatttatattatcttttctcatttaatattacaatagaagcatgcttctgccattaaaaacatctgaatcggattttttatcactttcaatttaaagcatagtcttcaaaggtaaattactaagaaagtatagatattttttaggctctaaatatacgtttctgaattgttttctagtaaaaggaatatttgtttggcttttcaatagcaaaggacatcctcagcattttttttaatggagaaaatgatagtggaaaagaaagtcatagattgcattttttcctagatcaggaattcataaataagactaagaggcaagacaccaaccaaaaaaagcatttgcaacaagtgtgacagatacaaggttaataaccttaatgtacaaagaattctcacagcaaaatacaaatgattaagaaacgctgagagtatcttcccatcattaataataataataaatacagtttgaatcaattaaatgtcattttgtctgtcaaaatggcaaagatattttcaaagcaaatgttcagcactgttaagggtatgtgagaagtcttctgcattgctagtgttgacaaaaacctttctagaaagcaatttggtattattgaataacggccttaaaatagttcatacccgtttgaactagtaattccatttctaataatataccataaagaaataattggaggtatgcacagaggtttgttgggggaaaatcaccacaatgataatctagtgaacaaaaataaatggaaacaagatttttgttatttggtcaagtaggtaagttcatatgatgggatattacacgttatcataaagaattttgcaaagactttttaatgtcatagaaaatgttatgccaagataattgtgataaaacattatatacaaaaagaatctcagatgtagtatattaattacaactgtgcatgtatgtgtgtgatgttagacttggtatggaccattttcccaatgtttttcagatgatttttcttttataaaatgaaatcaggaaatgtcatactatgtagctgaactcatatgacttttctgagtccagctatatatctattttaattgttgttaatgttccatgattcccaaattaagtggtttatgaggtttatattgatgctgaacattgaggacacatatggcactaaatcatatcccaggtgtctgagagcattcagatatgtcttgaaattttccagtgcaaatcaaagagggactctatgtcacaagataccagaagctcacatggtaaggtcatctgatgcagtatcaaacaaatatccccaaactgtgcattgaggttctacttgcaggcttcctccccttgtctcttctgataaccttctgcttattaatggaatgtgagttgctgtggtgatgggggtgaggaattaactggaagggaattgtgcaatatgaaggaaggtgtaatctatttaagtctgtaagagattacaagtcaccaagaaagcctgcgatggtgagaaaatgtgtgaagagcattgaagagcctttagccaagcttcagatcttattaacatcaaaattcattagcagtgatgaactctatgaatgtagtaatcatggatggtcgttcaagcagagtttggatgttattcattattgttaaatacatactgaagccataggaacgcatttgatataatcctaagatgtcactttgcctgctcttatgatgcaaattggcaccagaaatccagccaactttattaaaattgtggaaatctgactggactcagatccattaatccttgaaagcaggtaatacatgtatttttgccatcattatttctccagcacttatcacaatgtgtagcactttactaggtatacttttaaaatgttttaaaattcttatacatatataaataaagaagataaaatcaagttgactcaagtctagaaaacatggatgagggatttaagaattctaaagtgtttattctgaggcaccatattgctttatgtttggaggctcagtgtatattatcaatgtagaggcttcaagagggacccattatttcatatggttattctatcctttacttaggggtgttataatctcatgctatgattttgtttttattatattttgctttaaagtactatgtctgatattaatacatcatctttttattatttgcatgtaataacttattccatccatttattttcatctttgctgtatctttatgtttaagatatttctcttgttaattgcatgtagctgcctttataatggaaagatacataaatttcctttaattacagcatcctcaaatattctgtaattggagatttgatttcctctttgaaggaaagcttcatttattccttctccagtgctctccctttctttatgtacttccaagtttctgccctatatcattttctttctgcccgaagaaaatcttctaatatttcttgcagggcaggtctgttggtgatcaattcattctgtttttgttcatctgagaatgtctttatttctcctttactttttttttcttctcctttacttttgaaagatcttttcctatatgtagaaatctagggtggtagtcatttttcttttaacactttaaatatttcactttactcttgttgcttgcatggtttctgatgaaagctgctagaattattattcttattctattataagtaagatatttggtgttctctgagcttcctggatctgtaatttggtgtctgtcattaattttggaaaattcttagccattattacttgatatttcttctgctgtattctctttctcttctccatctgatgttccagttatgcatatgtgactccagatttgcctatccatcaagattttagggtgatgatttgccctgaaatttcatttctctgacaggtccaaaaaagtgattgatttttagtttgtccaggttttttttctggttgttggtgcctccagcctcacattgattctgtggtggaagaaaagcatggggaagcaaagagtcagtagatattgtgggttccttaaaaaggaggaaccataagccccatattttagggatgggaagaaatgccaggtaggtttgcaagatccttaagcaatgtgttcttttgtctcaccttctggctaaggccagagaggacaagactacaaaatagaattgtctgcgtggtgtctataattatttggagcctcttcatgtggtttccctcagctcagggtatttacaggagtatatgtgagacaaagacagcctcacggaggttaatagacctcagcatatcataggaacagtagaatgttttccatgtatatgagtgatatatgatacccaaagagatagttggacccaaagcagctttacagtaaagaaggaagctcactcaacagctacctgcttggacagacattgatgaacaaatatgacatgtatgccagcatggatacatgatacccaacatatgttacccatcctgatgttttgacactatttaacatccctagaacttaaatacaaccccaaagcagagagtgagagggggactccatactgctggagattaagtttccaccactcagtagaatgggaacttgacatataatttatgttgagttgcagagaaaataacttacatttcctgcataccggagtttgtcagataatacccatacctgcagaataatcattaacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccttatctattccttaacctcttgtcttagtcagttcgggctgctgtaactgactaccatagactgggtggcttaaacaatagaaatatacttctcaccattctggaggctgggaagtccaagacaaaggcactggcagatctgctgtctgttgagggccctctttttcctggtttgcagatagccatcttctcgttgtgtcctcacaaggtggagagcagaccgaggaagcaagctttctcccttctcttcttataaggtcattaatctcattatgagggctctacccatatgaccttattacctcccaaagtccccatctccaatacagtcacactgaggatttaggtttcaacatctgaatttggtggggccacaaacattttgtccataccacccctctatctactcctgcctccctctcatgctcttccaccttacatcctcttctctttcctcttgctttttctttttcttttcttttctttttttttttgagatggagtttcgctctcgttgcccaggctggagtgcaatggtaagatcttggctcactgcaacctccgcctcctgggtagaagcgatattcctgcctcagcctcctgagtagctgggattacaggcacttgccaccatgaccagctaattttttgtattttcagtagagacggggtttcaccatgttggccaggctggtctcgaactcctgacctcaggtgatctacctgcctcagcctcccaaagtgctgggattacaggcatgaaccattgcacctggcctcctcttgctttttctacttcaacttagtatctgttctttctccattatcttatttttccttatcttcctaattccatttacttccagctgctattttcattcatcttttcttattcctattatattctttcttcttttcttcttccctctcttcctcctcaattcctttctttcctacttgaccttctttctcatttctcccactcttcatgctcccatctaacaagatagtggaaaagagagaaaaaggtaatagaatgcaataaaaatgtacttaaaatggtaacaggaataggtgatgggtttgactggggaataaggcagagagaggcattatgaataacccaaagtaaaatagggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaaaaaaaaaaaaaaagcttcaatgtaaatccactctttcttcacctaaagaacagacagcttagtaaggcaattattttttacttttatttttttttgagacggagtctcactcttgttgtccaggctggagtgcagtggtgcgatcttggctcactgcaacctccgcctcccgggttcaagcgattctcctgcctcagcctcctgagtagctggaattacaggcacgtgccaccacgcccggctaatttttgtatttttagtagagacgggattttgccatgttgtccaggctggtctctaactcgtgacctcaggtgatccgcctgcctcagcctcccaaagtgctgggattacaggcgtgagccactgcacctggctgacaaaattttttaaacaatgaccgctctattgtagctaaataccagagaagactatacctctacccctactagcaaaggccaactagagagacttccacccttgccagcctgtaataagacctctagttccctgatagagtggtaagatgaatggggagtgggaacattctagtcccctcagttagtagagactatgtggggagcctagatttccacccctaatgagtgataatgaggtgcctctcccctaacaaatggtgtggtatcaagaggaagcctaatgaagagtcaggtttttatcaccacccaacagtaacaatgatacctgtctatcagtggtctcaatggaggccatttggagagaagtaactgggcacccagtctctcccaagcagagtggtactggtaaaagctggaactgtcacttagcccatggtgacaggaagctcctcaaccccaggtatcagtggaatctgagtatggaacctggacttccacctacatgtggtaaaacagaagatttaaataagacccagatcttcataacataatatgcaaaaatatccaggattcaactgaaaatcacttgtcatagtgagaactgtaataatcacaacttgagtgacaaaagacggtcaacacacatcaacatcaagatggcacagttattagaatcatctgacaaagatttttaaacagccgtcctaaaaatgtttcagtgagcaattgtgaacatgcttagaacaaatgaaaaaaaggatgtcttagcaaagaaattggaaatctctaaaagaaatcagagatataaagaaaaattaataggaaattttaaaactgaaaattttaatacatggactttaaaaaacaaacctcagtagatgaactcaacagcaaaataaaaataacagaagaattaatcagggaacttgaagatagaacaatagaaattattcagtctgaatgacagagaaaaatatactgaaaaacaaaacaacaacaacaaaaaacagagccttaggcacttgttggactattacaaaagatttaaatatgtgtcattgtaatcacagaagagagagagaagaggtactgaaaaagtgttgagagatacaatggctgaaaatgtcccaaatttgggggtgggggagacaatcccacagattgagtgattcaagaagctgagcaaccccccaagaagatacggtcaaagaaaccactttcaaacttctgaaagcttaagacagaacaaaaaatcttgaaacccaccagagcaaaatgacaccttacctatagagaataccaaagcaatgacagacagaagctctctcattagataccatagaggccacaatatttttcaagtgctgcaagaaaagactcattaacctggaattaaatacccaatgaaaataaaatacccaatgaaaataaaatatcctttagtaatgaagagtaaatcaagacatttccagaagaaggaaaactaagaatttgtttctagcctacctatcctaaaataatggccaaaggaagttcttataaaagaaattaagaattctaacaattgttcaaagaaggatgaacagcatttctacacaatctcatccagaaaataagaggaaacaacttccattaattctatgaagtcagtcttaccctcatcccgaaaccaaagtacacgaaagaaacttacacattaatatgtctcacgaacatagacgcaaaagtctttaacagaatattagtaagtcaaatccagtgttgtagaaaacgttatacaccatgaccaagtggaatttattccatgtacggttcagcatccataaatccagcaatgtaatccattatatcaacaggctaaagaataaaagccattatcatattgattgacaaagaaaaagcattttagaaaatccaacagttcatttttgctaaaaactgtcagcaacccactaatagagagtaacttcctcaatttgattttttaagatatgcactaaaccttcacctggcatcagacttaatggtgagagactgaatttctccttgccatcaggaacaaggtaagtatttgcactcaccactgctatcaaaatagtattgggttgctggatcatatgacagttctgtttttagttttttgaggaacctctatactgtttctaaagtggctgtattaatttacattccaaaaaaaatgtatgagtgttcctctttctccacatccttgccaacatccattactttttgtctttttggtaatagccattattaactggagagaaattatatctctttgtggttttgatttatatttctctaatgactagtgatggtgagcattttaaaaatatattcccttggtcatttgtatgccttttgagaattatctattcaggtcatttacccatttttaaattggagtatttgcggagtgtgtatgtgtgtgtgtgtttctattgagttattggagttccttatatattctggttattaaattccttgtcagttgaatagtttgcaaatattttctcccatcctgtaggttttctcttcactttgttgattgtttcctttgctgtgcagaagctttttagcttgatgtgatcccatttgttcattttttctttgtttgaggtgcttttgaggtcttactaaaaaaatctttgcccaaaccaatcccggggcacttccctaatgttttcttccagtactttaatagttataggtcttatatttaagtctttaacccattctgacttgatttttgtatatggtgagagataggtccaaaagaaagaaaaatcaatatatcaaagagataactggattcttgtgtttattgtagcactattcacaatgccgagatagggaatcaacctaagggtccatcagtggatgaatggataaagaaaatatggtatatatgcacaatgaaatattattcagccataaaaataaggagagcctgtcatttgcagcaacatggatggaactggaggacattatattaagtgaaataagctagacacagaaagacaaatattacatattctcacttatatgcaggagctaaggaaaatttgatttcatggaagtagagagtagagtgatgattaccagaggctgagaagggtggggggtggggagcttaaagaggggttgtttaaggggtacaaaaatacagttagatagtaggaataagacttagtagtcagtagcacaatacagtgactatagttaacaatcatttattgtatgtttcaaaataactaggggagtggatttggaacgttcccaatacaaagaaatgataaatgtttgaggtgatggatatctcagttaccctgatgagatcattatacaagatcataccctgatgagatcattatacatcatatacatgtatcaaagtatcacatgtaacccatgaatatatacaacaaatatgtatccataaaaattaaaaattaaaggtaaatctaagcatgcttcttaaaaaacaaagcacaacaaaaagcaaaataataatggaaattctagccagctcagtaaagaaagaaaagcaatacagatcagaaaggaagaaataaaactcactatttccagatgtcatgatagtatatgtagaaattcccaaaatctacaaaaaaaaagaaaaaatctcctagaactaataagtgagtttagcaggtcacagggtacaaggtcaacttaccaatatcaattttatttctatatcctagcaatgagcacgtggaaattaaaaatagaatactgggctgggcacagtggctcacacttgtaatcccagcactttgggaggctgaggcgggagcaatcacttcagctcaggagttcgaaaccagcctaggcaacatagggagaccacatctctacaaaaattcaaataattaactgggcatggtgtcacgcacctgtggtcccagctacttgggaggctgaagtgggaggatcgcttgagcccaagagttgaaggctgcagtaagccatgatcgcaccattgcactccagcctcagcaacagaacaaggccctgtctcaaaacaaagaagaaaaaaaagagaatacaatgactcaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactagggcttgttgaagagttcttagaaatgaaataaaacccacaatccataaaaggaaaaaaaaaaaccaataaattgaatttcttcaaaatttcccctgcaaaagtctctgcaatctgggagaaagtatttgcaaaccatatatctgacaaaagactcatacataaaatacatgaactctcaatattcaacagtaaaagagaaaagaaagaaaacaatgcaattaagggtaatgggggctgggaaggaggtggggatggttaatgggtacaaaaaatacttagaaacaatggataagacctactacttgatagcacaatagggtgactatagttaattgtacattttaaagtaacatagtgtaattgggttgtttgtaactcaaaggataaatgcttgaggggatggattctcagtgatgtgcttattttacattgcattcctgtatcaaaacgtctcatgtaccccatgaatatatatacctactatgtacccacaaaatttttttaattaaaaaataggtaaaaggcatgaagaggcatttaatcaaagaggatatatggatggcagaaaagcacatgtaaagatgttcaacatcattagccattagggaaatgcaaattaaaaccacagtaagatattactacacacctatggccaaaatatactgacaccagcagatgctagcaaggatttggagaaactgtatccttcacacatagctggtgggaatgtcaaatggtatgatcactctaggaaagtttggtaatttcttgtaaaactaacatgcacttactatataccccaacaattgcactcttgggtacttatcccagagaattgggaacttaggttcacacagatacttgtacacaaatgtgtgtagcagcttcattcacagtagcccaaaactggaaatgacccagatgtctttcagtgggtgaatggttaaaccaactgttgtagcacctctataccatgtaatagtactcaacaataaaacaagaaactctgatacacaagacaactgggatgcatctcacaggcattatgctgagtgtgaaaaaagccaatctcaaaatgtgacatattgtatgattacattttcatgacctcttgaaatgataaaattatagagatggagaacacattagtggctgccaggggttagggatgggggcggtggaggagggttggttgtgactataatggggtagtaagagggaaatctttgtggtgatgaaatagttctgtgtcttgattgctgtggtgtttgtagagacttccacatgtgataaggtgatatagaactatatacacatattgtaccaatgtcagtgtcttggttttgattttgtactgcagttacacagatgtaaccattggggaagcagataaagggtacatagaacctcactgtactatcctcgcaattccctgtgtatctgtaattatttcaaaataaaaagtttaaaaagttttttaaaagcagaattaataaaatattacctaaaagcagtagggcatcagttatatttcaaaaatcatgtcatagggccgggcatggtggctcatgcctgtaatcctaacactttgggaggctgaggtgggtggatcacctgaggtcaggagttctacaccagcctggccaacatggtgaaaccccatctctcctgaaaatagaaaaattatccgggcgtggtggtgggtgcctgtaatcccagttactcgggaggctctagcaggagaatcacttgaacctgggaggtggaggttgtagtgagctgagatcatgccactgcactccagcctgagtgaaagagtgagactctgtctcaaaaaaaaaaaaaaaaaaaaaaaaagccatatgtattagctggttggataccattgctgccgctactgaacagtggacaccggatgttagccctgccactaatgctgcccctagaaactggattttcttgtggctgctgctcccaccaccacaactatggtggtgaattccatcactgcatatttgaatcactcctttgaaacaaagtgttaggtctaagttgtaactgcagtgaaagggttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggcccacactggatagtttgtgctaacagtgtgatttgtggtgtgagccttgggctgagagatactagtttaacctctgcatggactagagactgaataactaaggtcaaccacacaggtgctccatgcctatctgactgaaccccaaaaacaactctgggcaccaaggcttgggtgaacttccctggttgacagtatttcatacatgttttcacacatcattgttgggggaattaagcactggccatacaactccattgggagagtacaactgaaaagtcgtgcctggtctctcctgaatttttccctatgcactttttacttttgctgattttaatctgtatcctttcactgtaataaacaatagccataacactttttctgagttctccgaatccttctagcaaatcattgaatctgaggatggtcttcaggagcttgccacactggtaaatcctagatcacattctcttagctgccaagggcatgtgaagaagtgaatatctggcctttgtggcttttgcacttggaactgttaagtaagaatatatatgaccttactaaaatgttaaaaatcgaaatacatctggccccaagggttttcagtaaggatctataacgctatataaagaactcctaaaagtcagtaagacagacaacccaaatgaaaaacaggtaaaatatacaagcatattacaaaataaatctaatatgttcattaatgtataaaaatgtgttctaccacattgcttatcagaaatataaattaaaaccataaggagataccaataaatacacataagattggcaaaaaaaaaaaaaaaaaggaaaagtcttgtagagtatgtcagtcttactcctgggcttctggtgtcacggaaataaagacaaacattaattattaaagtataagaatacatgtacaagtatttttattgcaatgttgttgtattgccacgctccccacaaaaatcctgaaactaaaatggattccatccatgggggaatggttaaatacattgtggtacattcttaccatggaatattatgcagtcatttaaaagaacgaatcacaggtagactgttgtcaaataagataattcagacacataaaagttcatgtaatcttaaatttgtaaaaataaaaaacaacttttgagtatggaaggatatcaaatggtgttaaaaacaagtgtttggcaggtgaaggtagaattgaaaggaagtgggaagcagtaaggaaaagaatgcaatttaaggtctggcatatataacacatcatttatgtaacaacatatatgtgtgtaaagtatgaaaaggtagcaccaaatctaagcaattgtccaaggtgatgagatttagtgatgtttatttaatttctaaaatatttaggcagtgtttgaatgtatagtgatgagtgtgcattatttgtataatgaggaaaaataagtgaattgatcacaggaaaaattgcctctcaggtttcttgctttagcaatgggatggagagtgcgattcattcatttaacaaatatttattgaggatataaaaatgtgccaggcatggttctaggtgctggggaaacaacaatgaataaaacaaaaatctgtctccctaagaggtttacactctaaatgggggagaaaggcataactagaggagaaacactgtgttggtgggaaggaggaggcgtatgaaggaatcggtttgggacctgttaatttagagaatactgagagatatccatttggagaagtgaggtaggtagttactatggatctagaattcataggccaagtcatgaccgaagatacagatatggaaacagatagcatagaaaatggtgtttctgacctcctttcctgagtctgatcacgtctcactgcagacactttacagaggaagtgctgaggaaaaacaggcagctgacagaggaggttgctatgcaacagatgaggaaagtcatccagccaggcagaactgatgttggcccttggggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaattagatgtgctctctgcttctttttttccctatatttggggagcgagcaacatgtttatgtgggagagacaggacctcagctgtagtttgaagggtagatcagctttcagcaggtggaaatgtgggaagatctagctactggattgggatacaaaggcaggatcaatgaacacgagacccaagaactagtatagtttattcaataaatatcacttaagtgactctcatgtgatagatatgctgctaggtgtcttggagtgacattgcgagaagtcgcatagtgagagagggtattggtgctcagacagttgcacttaagaacacagaggaggtggagctccaggtgatgataaggtccagagagtaggtagttgaaggggacagaaggtgactattctggagataaggggtccatggcctgtgattctagggtgttggttatacaacccatgtggaaagtgaaagaactccaggagggcagcaggagtaggagtagagaacactatgagttagatgccagagtctcctctgtgagaaggaagatatacccctagccacattgctcataaagggatgggctcacaggcactcctccccatctctggaaatgctgcccaggatcctgtccctctaggaggccctcacaatcttcccacttgcacaggaccggggctgcctcctcgagacaggatcttatgggcagtgaaggaggcctcacaatggcctcttctctcctgcagggagaaagagaagactttgttacctcaagaacaagaattacaaagtaagacaaagctccatgcacaggctttgactgtgactgtgagcaggaacttggcttgagctgctgagttctatgctggaagcaaggctctcccactgaggacaaaattaggcctaggccatgacttccttgggtgcttggtggtatctggacatgtggacaagggcagagacgggagctcctggggcacaaaaaagagcaaaggcaatttggcctcctgggaagggtttggtagtgggtagggatggtgtccacagcttccttaggttcctgagtgatgtccacattctgaggagagagcccaggattaataggaaggagacagcagtgcagggccccaacgcctcccctgcctgttgtcctcattgccaggctcccctctttcagccaggcctggatcctgaccctcaggtaggcctggaggaaatctcagcctgaggcctttttggcagggattgcaccagccctgcatctccatgatgcctcaggtctgggctgtagttcctgcatttctgggtgctgttttttccaccttttggtgcaaaacacccaggctcggtggggttggggcagtctttctgtggagaaggtgcttccaccatgtgctgtgtccacagccagcttgggtaatggagtcccccacctacctcaggcttctcccggtgtgtgttcacggcctccacattcaggtggacggactccaccttgcagccttggaaaagaacaatccatctttccataagtccccaaggtaggcacaggtcttccatggggtatcacctccctcccatcaccacccacactcccagcttcatactgtgtacagatcatgacttgcctggggaatttagacagctgtgtgatgtgtggggaagacaccaggcctaagaggcagccaacagggcatcctgtcacctctgcccctaacagtcttagttctctgagctttagttgctcatttgtaaatggggatggagatgagagatgaactctacggctgcccacagctcttgaggtccgcaggacatcagtcgcatctgtgtaatattgatgtagctctgtggatcctccaagccgtgttaggtgctgaagaggtgcaagagtcctggggctactgccttgggtgatcagtaccaggcaaagtttatcaggaggacaatgtggttgtggcaacaccaggagtgtggaagatcacgtgggagttttagggaacctgaagaaggaagagggtgcatctttggggtttggggctgcatctttggggtttggggctgacagaggaggcctaatgcctgtggaagctctgtggactgcaccttactccaggcttcagtaggccattctgctctgtccacaccccagaataggtttgattctgtcccttccctgctcatgaaattcttgtgtaatttgcacaattggcaaaatcagaacaaagtctttagatttagattagacaacaatattatattaatgttagtggccttattttgattatattatttttttctgcaagagagtgtctttgtaatttagtctccaaatatttatggaagtgtgtgtgcgtgtgcacatacatagagagaaggagagacaaaagacagggaggataaaacaaatgtgataaaatgttaacattgaagaatctaggttaagtgtagacaggaattttttttaactagttttgcaacattttttgtaagtcttcaattatatcagaataaaaatttaaatttaaaaagtacttttatttttacaaatattcactgaaattcatctgactagcatgtactacacacacttctttttttatcaccaaatgctcacttccttttaattattattattatttttaattaatttctataggaattttttaaaattatactttaaattctagggtacatgtgcacaatgtgcaggtttcttacataggtatacatatgccatgttggtttgctgcacccatcaactcgtcatttacattaggtatttctccttatgctctcactccctcagtcccccaccccctgacaggccctggtgtgtgatgttccccgccctgtgtccatgtgttctcgttgtttaactcctacctatgagtgagaacatgcagtgtttggttttctatccgtgtgatagtttgctgagaatgatggtttccagcttcatccatgtccctgcaaaggacatgaactcatccttttttatggctgcatagtattccatggtactacacacacttcttgacattgcaccctttgggaaaaggtcactgtgcaacatgatgcagttattcttcatacaaacaaaagtgcattcactcctttccaaagcaagaaaaccaaaagtctcataagctgttgcatgcagatccaaatccagggataattgttcatcctaatttagcagggattttgaataaggacatgtgggaaaatatccaaaaaagaggtctagggaagtggtatgtggacttcttgggattgatccaaagcatgagacttagtgttaaatgtgcattctcaccaataagctcttagtaatcaggtgagcagtattacctactcattggaggtcaggaagactgttttctcagctattcctgtgcttgctcgatgggcacctatacaaagtcatatggtggcatgaacagaggctatgtatggcctcaacaaaaggcgctcacaaaggctgatatgactacccctactgctgagtgtgcaaatttccaaaactatcctgagtttctgatatgtaccaatccaaagaggaccagcccagtacctggcagtaaattaattacattgggcccattacatcatggaggggtttgttggctttatgatttgtcagcaataagtgaatattctaggtatggatttgccttccctacacacaatatttctgtcttatcaccacctgtgatcctacagaatgcctcattcactgttgtgaaatttcagcgtgggatgacaaaaaaatatgtgtatatgttagccaaatgaactgtggtgaatatttatcttgttggtatcctgattgcacccattttccttttaggataatacagtttccaattgtagtaaatgggattttaggatggccgacaagatccctaccctctggtgtacatagactttttggcagttattcagtaaaacactaatctagatgctgttgtgaaaggattttgtacatgtaattaacatccaaaatcagttgaccttaaaatcaggtgggcctgacctactcaagtaagactttagagggtactgcactcatcttgggaagagagatttgaagattgagagggatttatgcatggaaattctccattcctagatttgaagatggagatgctacatggcaaagaatatgagtggcctctatgggattaatgaggcctccagctgatagccagtaaagaaatgaggacctcagaactatagctgcaagtacaagagttctgccaataatctgaatgagactggaaggcatcagaaagaaaggcagccctgctgacaccttgatttccatcttgcttgaacagagaacctagccaaggcatgccacaccttttgtcctataataacttgcagataataaatggatgttgttttagccactcagtctgtggctgtttgctatgcattaaaagaaaaccaatatgtagtctttgtggaatgacatgtctagatgttttcctccccttattgacaaggagtaaatcagattattcctctctggttccaatattgccacgggacaggcatgcaacctattcttagtcaattacatgccctctccttggactttgaaacttaagtgattgacacaagagtgaaaaaaaaggcttatgtgatttttatccccagagcagcatccttatcagaccgttcctgtgtttcatgctcctatccagttctcaagttactttctccagtctccttccagttctgtgagcctctgacatctgtctaacaaaatccattttatttacattggcaaagaaaaattcttattgattgtgaccaatcatgtggtgaagccagtttgtaccagcttgagacagtgtattgtatgtacctcgtcccacctttgccttcagtgaaattggccatggtgggattattaactttgtgaaaaatggcagactaccaattgggaatttttaaaatcagagaactagttattaaccatttaccagcacatcattgcttgcaaacaaaatcttaagtaatggaatacgtatggattacaaaggggctggacactgagctctaggagggcaaaggcagcagggtattgtggaaagaacttggatttcaccatcagagaatcctagattctaatcccatgtttcttcagtggtgtgactttgagcaagtatcttcgcctctctgagtcttagtgtactcacctatgaaagtaggtgaggaaatacaccatttggcaaaaactgaattttcatgcactcccctacatttcccagccaactttcttgttgtgttggggtcatatgactatttctggccagtgtacagaagtgatatctgcacttctaggataagacacctaaaagcccaaatatcttcaaaataatgtgtgcccagcagagtcctggggtaggtaccctgaatgggtggttggatatcctcgcgggggcgagactggtgcagtaggatgataggggaaggactgggatggcctctgaacctggagcctggcatcaaccttccctgtctctgacagagcagtaagctgcaaaagggctcacatgtgggaggtgattttagtaagtttgatttggtgtggagaggggcaggagaatgatgcagaaagactggactagagggcccagaggggaccaaaataacaagtgtaggctgaggccagattgaagaaaggccttaaagacaagctttggcaggttacactttctcctggggcattagacacgtacataatgtcaatttttttcatcgactgattttagtatccattaattattcttcccttgtttaattattaccatgtttattgtgcaaaaataactttctatttccatgattctttctctttcagctttattgaggtacagttgacaaaaattgtgtgtgtatatatatatatatatatatatatatatatatatatatatatatatacagagtacaacatgatgttttgttttgtttttgagatagtgtttcactctgtcacccaggcaggagtacattggcgcgatcacagctcattgcagcctcaacctcccaagctcaagcgatatacctcatataaacagaattacatgatatacctcataaacagaattatacagtatttgtctttctgtaacttgtttattttacttagcataatgtcttcaaggttcattcatgttgtagcatgtggctaataaaagtccattatttttcaaatctgaataataaaacattttgtttatccattcatctgtcaatagatactttgaattctcccacctgttagctattgtgaatagtattgctatgaacatgggtgtgcaaacatgtctttgagaccccgatttcaattcttttggatatatacccagaagtggaaatactgaaacatatggtagttctattttttagtttttgaggaacagccatactattttccatagtagttgcacaattttacaatcccgccagcagtgcacaagggttccaatttctccgcatccccagtgacacttattttctctcttttgatagcagccatcctaatcggtatgaggtaatatctaattgtgtttttgatttgcatttgtctgatgatcagcaatgtttagcatctttcaatatgcttgctggccatttgcatataatctttggggaaatgtctgtcttttgtccattttacaattgggttacttgtgtttttcttttaagaaatagggtcttgctctgtcacccaggctggagtgcagtagtgcaatcgtagctcactgcagcctcaacctcctgggctccagtgatactcccacctcagcctcctgaacagtgaggactacaggtgaacgccaccatgtctggctaattgatttttttttttttttagaaacaggttctcactattttgcccaggctggtcttgaactcctcacctcaagtgatcctcccgcctctgctgagataggataacaggcatgaaccaccgtgctaagcaagttatttaattttttgttgtggagagtattttttatatattctgcttattaatcccttattaggtatatactttgcaaatatcttctcccattctgtatgttgccttttcactgtgttgactttgtcctctgatacacaaacgtatttgtttgatgtagtcccatttgtctattttttgcttttggtgtcataaccagaaattatttgccaaatccagtgtcatgaagattttctatctttacttctaggagtttttaaattttaggtcttacatttaaatctccaaactattttattaatttttatggtgtaaaaggtctattttacttttttgcagatggatgtccagttttcccagcaccatgtgttgaagattgtcatttccccattgagtaatcttggcacccttgtcaaagatcatttaactacatatatgagggttcatttcttgactcactattctatttcattggtctatatgtctatgccggtaccatatatatataataaatattataatatagaatatatatatacaatatattatatacaatatattattatatatatattatggttttcagtgtataagtctttttgctaccttggttgggtttattcctaagtattgtattctttttcattgtattgaaaatggaattgttttcttaattttctttttgaattgttcattgttactgtataaaatgcaatttatttttgtgtgttgattttagtatcctacaagtttcctagatttgtttattagagctaacagtttttgtgtgtggaatctttagagttttcagcatataagaaagatcatgtcatctgtaaacagagataattttacttcttcatttccagtatggatgctttttactttttcttttccttttcctgattgttctggataggactttaacactatgttgaatagaaatggctgcagtggtcatccttgtcttattccttaacttaaaggaaaatacttggctcattaaattagtttggaagtgttttctattcttatattatctgtatcttatattgtgtgaaatcaatactaattgtttaaatacttgattatattctcatgtgaagccacctggacctgtaggtttctttttatggagcattgaaattacaaattattttatttaatagttatatacttctttcatctcaattgaattttgttatcttgtagtatttaaggaattggttcatttcttctaagttgtagcttttataagcattaagttatttgtcatgttccctattatccttttaattcttgcagggtgtgtagtaatagtcttatttcattcttgatattggtcatttatatcttttctgtttttatttttgtcagctttactgaagtttgatcaattttattgatattttcaaagaaccagcttttgttgcattgatgttctgtataattttcttgtattcaatattattgttttctattctcgtctttattattactttccttctgcatgttttaggttcaatttactcttctttttctagttacttggaatagaaacttagatcattgattttacgtctttcttctttctaatgtaagcatgtagtactctaaatttccatttcatctttgctttatagtattccacacatattgatattttttgtttttattctcattctgttctatgtatttttaaaattttcttagaaacttctttgattcatggattatgtagaaatatgttgcttaattcacaagcatctgtagattttctgttgtttttctgttattgattactattttcatttctttatggatagagaacatactccgtatgatgtcaattgttttaatgttgttgaagttttccccatagtgtatcctattgaatgttccactggtgcttgaaaaaatgtgttttctgctgttgttagttggagtgctctttctatatatatgtgtcaattatatcatattggttgattgcattgctcatttcttttatgtccttccagatatactgtttagtagctttatcaattgctgggagtgcactgttgaagtcccctagtataaatttaaatgtgtctatttcttctttctgctctatcagcttttccttcatatattttgaggctcttttgtttgatgcatacacatttaggattgtagtttcctgtaaatcgttgtaaatctcggtgattgaccttttatcattacgcagtgtctctctgtctccagtaatttcctttgctctcaattctactttatttgatattaatatcaatactcctgctttcatttttgttttgagacggagtcttattctgtcgtccatgctggagtgcagtggctcactgcaacctccacctcccaggttcaagcgattctccggcctcagcctcccaagtagctgggattaccacgatgcccggctagtttttttttttttaatagaaaaggggtttctccatgttggccaggctgctcttgagatcctgatctcaagtgatccattcgccttggcctcccaaagtgctgggattacaggcgtgagccattgcgcccggcccctgctttcattcgttaatgtttgcattatacatcactttccatccttcactttcatcctactatgtctttgtatttttatttctttttaaattgatacataatagttgtacatattttgggggtacatgtgatattttgatacctgtatacaatgtgtaataattaaatcagggtaattgggatatctgtcaccaaacattatgttgtctttatgttgggagcattgtgattcttctagctattttgaaatatacaataaattattgttaactacagcttctctactgtactattgaatactataacttattccttctatctaactgtatttttgtacccctaaaacaatttcgcttcattgcccccttaccttttctggcctctggtaattacggttctactctctgcttccatgagattcactttttaagctcccattaaatgggcatgggaacatgcagtattcactcttaaatgaatgagaacatgcagcatttgtctttctgtgcccggcttatttcacttgaggtaatgacctccagttccatctatgttgctgcaaatgataagatttaatacttttttatgggtgaataatatttcattgtatacatgtaccacattttctttatccatttatctgttgatggacactgaagttgattccatgtcttggttattgtgaattgtaccatgataaacctgggagtgcagatatctcttaagtatacttatttcctttctcttggatatataccctgcagtggaatttctgagtcatatggaagttctgtttttagttttctgaggaacttttctatagtggctgtacaaatttaccttctcagcaacactgtaccagttttccccttactctgcattcttaccagcatttgttattcttgtcttttttataatagccattttaactggagtgagatgatatctcattgtgattttgatttgcattttcctagtgattgggtattttctctatatccattggtcatttgtttgtcttcttttgagaaatgtctattcagatcttttacccattttaaaattggattatttgttttttttttgctatgagttgtttgagttacccattgtattagttcgttttcatgctactgataaagacataaccaaaactgggaacaaaaagaggattaattggatttacagttccacatggctggggaagcctcagaatcatggtgggaggtgaaaggcacttcttatatgttggcagcaagagaaaatgaggaagaaacaacctttgataaacccatcagatctcgtgagacttattcactatcacgagaatagcactggagagaccagctcccatgattcaatcacctctccttgggtccctcccataacacatgggcattctgggagatgcaattcaagttgagatttggtggcgggacacagccaaaccatatcacctatatattctggttattaatcccttgtcagatgaatagtttccaaatattttttccattattcaggttgtatcttcactttgttgatggtttcctctgttgtgcaaaaggtgtttatcttgatgtaatcttatttgtctatttttacttttgctgcctatgcttttgaggtcttaaaaaaatctttgactagaccaacagtctaaaatgttcccccaatgttttcttttagtagttttatagttttaggtcttagatttaagtatttaatccattttgagttggtttgtgtatatggtgagagataggggtctagttttgttcttatacataaacacatcaagttttcccagcatcaattattgaagtgcctgtcctttctgtaatgtgtattttggttcctttgtcatttaggtctttttatccattttgagttgagttttgtgtatggtgtaagataacagtccaagttcatttttttcctcgtggaaacccagttttcccagcaccatttgttgaagagactatcttttcccccattgtgttctcttggtgcccttatctacaattagttgaccgtatatgtgtggatttattttgggactctctattttgttccactgttttgtatgtgtttgtttatgacactaccatactgttttgattactgtagctttgtaatataattttaaataaggaagtgtgatccctccaactttatttttcttcctcagaattcctttggctattcagtgtctttgtgattccacacaaattttaggattatttttcctattgctgggaggaatgccatggcaattttgatagagagtgtattgaatttgtatattgttttaggtagcatgggcattttaacaatattatcaggttagtgcaaaactatttgtggtttttactgtaaccaaaagaaatggcaaaacccacaattacttttgcagcaacctaatagttcttccatttcatgagaatggactatcattccatttatttgtatcttcttcaattactctcctcaatgttttatagttttccatgtgcaggtctttcatctccttggttaaatttactcttaaatgttttttaatgctaccataaatgggattgttttgtatcctgcaattttcctgaattgatttattagttctaacagtttttttgtgtggaatctttgaggttttctatatataggattatgtcatctgcaaatggagataattttacttttcttctttccaacttggataccttgtatttcttttttagcagaagtaagtaataatgatcagaacagaagtaaatcaaatagagaatagaaaaacaataagaaaaaatcaataaaactgagtgatttttttcaaaaaaagctagactaagaagaaaaggcagaagagtcaaatcaataaaatcagaaatgaaaggggtcataaggggctattatgaacaatacacctgcagactggataatttagataaaatggacaaattcctgaaaaaatacaacctaccaaggttgaatcaggaagaaatagaaagtctgaacagaacaataacaaatagattgaagtggtataataacttaaaagctcccagcaaaaaaaagcccaggaacagataactttatcgttgaattctgcaaaacattcaaagaagaattaatacaaatacttcttcaactcttccaaaaactagagctagagggactatttccaaacatattttatgaggccagcatcaccatgatacctaagccagacaaagacaccataaaaaaagaaaacttcaggccaatatctctgataaacattgatacaaaaattttctataaaatattagcaaacccaagttcaacaacacatcaaaaagattatacatcatgactgttatgatttgaatgtcttctccaaaactcatgttgaaactcaatccccagtgtgacaatattgagaagtagagcctttaagaggtgaataggtaatgagatctctgccttcatgaatggattaatccatttatagattaatggattaatgagttaatggactaatgggttatcatgggaatggaactggtggctttataagaagagaaagagactcaagcatgctctgccacctcaccatgtaatgccctgagccgcctcgggactctgcagtgtccccagcagcaagagggttcttaccatttgtagtcccttgaccttggacttctcagcatccataaatataagaataaattcctttttaaaataaagtaccctcttttggatattctgttataagcaacagaaaagactaagataatggccaaatggaatttatccttggcatgcaagcctgttttaaagtatgcatatgaatcaatgtgatacattaacagaatgaaagataaaaagcacacaaaaatcatctcaatttacacagaaaaagcatttgacaaagttcaacatccttccttgataaaaatgctgaacagtttaagtataaaaggaaagtttctcagcaaaataaaggtcatttatgaaaaacccacaattaatatcataatcaatggggaaaaatgaaaaacttttcctgtaagatccagtgcaaggtaaagattcccactctctccacttctattcaatatagtacaggaagtactatgatgtaaatttcttgtagatagtatacattggattttttgaaaattcatactgccaatctgtttttttgccaagtatttaaaaaaatttttttataattaacacataataattatacatgtttatggggtacactgtgatgtttcaatacatgtatacattgtataatggtaacatatattgaaacatgtatacattgggtatacatgtatacatgtttgggtaattcacagatccatcaccttaaacatctatcatttcttggtgatctaatctctttttaattggtatatttaaaccatttttatttacaataactgtccctattttaaggcttaagtatgccattttgttttctgtgcatccctctgttttttgtttctctctgtctctgtctctctctctctctgctccctataggttatatgaacatttgttaggattccacttagagtgaagtgtagaaacattacttttgatgtgtttttgatcctgtgttaacactgcttaattcttggtgtttcaatttggtataatatattgcttttgcctttatattttcgtatagtgcttgatttttataaagcaatgaatatataataaatttgtgaagtcactatccttctattatatttgtaaatgtagctatatattgtcaaggaaaaaatgtggctgatttacactgttattaaaacttgaaaatcctcagtatttatagtttttagacttgacacacttgagatttgagcagcaaaatccttttttacacatgacctaattttttctatgatcatatcagtttctacccaagcattagtgatttaggtcactcggatgggggcaggtttctcttacaactcatctccagctcaagaaaagcctctttctctcaagcttcttcctcactactcccttagaggaaggaagaccaatgtgataggtcaaattctggagcactgtaaggagtaccactgtgcattgctaagtgacacccatacatgtaagacacatctaagctcttctctttcttatgatactgaagtgatgagataagctggtgctgactgtgaaagctgggcattgacacactggcctctctttcttctcactggagattttgggctctgtcattcctgcctactaggggtcagctgatgataagatttctgtagaataaaagaggcaaagataccctgcttcattcttgtgcctaaacctgtgcttcaattcaagttgacctgagggctctgcactgaggggtcatgggaactggcccagtgaatgatatttcaggtccttgtgtgcatgtctttttcaaggaaagccctaagagggggcaataaagcagtgtaacataggagtagggtgttcttgtatcctctgaacaaatgctaacctcacactgtcagattcttaccagtaatgccacataattggataactctcgttctactgcaggtggtgcagatggcgacccaaatgtcataatccacattgaaatgtcacacatacccactcaaatagacatgccctcaggtgttgccatgcccccatccagatgtcagcactaggtatttgcagatatgattggtggacttcatgtatgaaaagacaagggtaactttctgtagttattagtagtttcaatcatttgcagagtcattattccctccctgttctcctttttgtttcttccccatttattctttagggtgttctatgatacttagccttattggcacctgctttcatttcctgaattcgtatcaggatgtcacccgtaccctgccttcttagaattcatggtgatgcaatacaggcaacttaaataaaaagactgatgggaggcctcttgaactctgttagtttccctactctttacttttctttttatgtttcatgcaccatgctcaggtgctgtgaaaccagttcctggtttttaatctagtctcacagtaagcaggttgtcctcatttagctaccattttacttctcaataatttaactttgacattaaattgtccaaactgacaaacacatcccaggtgaacttgctgtttttttgccacttctcagttgtcttaattacagttagaattggacaattaagttcatctttagtaactgcacacacatatttaactaattgttgtctttccttgcacataatgctattctatgtacctcatattatttgatttctttgaaagagagagcacatatcgctcttgtgtttttaagaagtaactttcagctctcagtaagttatgtatttgaaattttgtcctgcagcattgctaccactttccaatatacattttctcttgtacacaaacctcacacaggctcatgtcaaatatttatataagcatagtcaaaacagggtgaataaatttctctttggtggtcagtttccaattacaccttcacatgacaggtagagcctgctttagagtctctataatcaatcctcaactgtctgttacacaacagtttctccaccattggaaaatcaattctctgttcccataggctttggtagagttacattcctctgccatctcgaaacaaatccatttgtgagatcatactcatatcacatggtaccatcacacaagttgagccccagcggaatggtaataaagtaagtattcctaatacatgctcatgaaaggggactggaatcaccctatgacaaagttaagattggtgcagtaaagtggtctcaggatgggaggcacttttccatttcagtttctctgaatactgaaagtcttgacaaaaagactttatcagcttgtattaacaataccagctcatgaggaattaaaaaatttaataccaggccaggcgcagtggctcatgtctgtaatcccagcactttgggaggctgaggagggatggctcacctgaggtcaagagttcgagaccagcctggccaacatggtgaaacccagtctctactaaaaatacaaaaaattagctgagcatgatggcaggtgcctgtaatcccagctacttgggaagctaaggcaggaggatcgcttgaacccaggaggcggaggttgcagtgaaccaaggtcacaccactgcacttcagcctgggcaacaagagcgaaactttgtctcaaaaaaaaaaaaaaaaattaacgtgagaaacctgtaacaccatcctgcagctttgcaccaagattaccttgtttaatggtcatagttggtaatatttatttgtgtcaggggaataacattttcatggctcctgaatttaagtttcctatttagtaggtttatttttatctaatgaatttaaaataccagcatgagtattttgctaagagagaggattagataacaccctagtgtcccagaaaagggtatggatacttcaccacaaaatattcaaaatattcccaagagaaactttttagtttatgctattcactatgtgaaagaagaggcatccaccactcttgttcattccctaaagtgctggtagtatttgctttgtaacaacatacccctgttaaaattcttttgactatcacctataggataaacatagaactctgtgtcatgtgcctttaagattttctatgttttgactaaacttccttagcaggcccatttttctccctcttctcccgagagtcaccacccactcttacccagcaccttcattagcatagagctctctgtccttttttcttttttcttttttcatactttgcatgggaataactaaaacctttattagatatgattttccattaacaataatgtgaaaattacaattatgaattcaaaaggcagtgaagtctgaacatttaaaaagaagactaggtgttagggaacaaaaggtaaaggaaggtgagaatgtttcttttatactattcattatctcccctctgtacacagtgttgcatatatacaaccacttcatttttactgactttatataatagtgaaatccccttaagcaacctagggtatacagttggggtccaactttcagggggttgggggtggggagtagaaacacacttgattaacagttttcacccacacattttagacaatttttttctttttttgccaagattttagtagtaagttcacaaatataggaaatactttcacttcttcagtgttaaaatggaaaaccaaacagtgctgacagtagtggcttaattattggtatacaagaaaaacacaacaccaatgggttttcttaattatgcattttaaatatcagtatgtgcatttgtttttacagttataaattttctcatctgttttagacaacagcttgtaatagttttgaatccattaagatgttgctttcaatttgaaatattttgtgtatacacgtatataaaaaataacccaaagtatgactcatctgacagatgtttaagatcaataaaggcttatttttcaacatgcagttaggaagagagggaagcaagccaacctctctacactgtctttttgctggcttgtttttgcagtggtatcaatagtggtttttgaagggagccgtgtgccgtcagcctatctagttaagattagataccacaatcaacaagaggagtagaagagatggggaagggggagtaggtaagtgttagatatcaattttttttaagtgtgcattttgtactcttctaggtatgggattaaaagcaggccagtgaggaaaaaaatgttttaattaggaaaaaactgcaatcaatcaaatcaagacataatagccgaactaagttcttttaatagactgcatatatagatgtttagccatactcttagatgaactttttaagagtagaactttatatccaatttacatgctctagataccacctttcttattttttatagtaaggtctggtattaaaatacccacttgtacactgacagctttaagaaaaacaggacacagagtgagtcgtcatttttagcagcaatgaaataccactaacccatttttacataccaaattcaagtcactatcagaggtgagtgtcacacagtcaccaggtataaaattgctagttcatttttaaattaataacttgaaattacccatgcctccccaccccattacatctttttataaacagaaaacattttgctattttatacataggctagcagccttgttttaatatgaaagtgctaattcatttacagatttgtataatcagttatgtagtgctacagtaagtgtccaataatctacataggaacaacgatgaatgaaaatgatgaagattgaataaggctatcagattaccttattttatgtacatataaagaatagacacccaatggcgaggaagagatagaaattggacaaatacccacgggtgtaaacattacatctacttttgagctttatactgtaaatgaaacattttaaatagtcctgtagcccatgcctattttttcctcagaaaaagaaaagctgccttcatgacatcccctcttgtttcagatttccacagtgtcactttaaagcttcagagtcaggatcttactttcttcaaaaaataaagaaaatatgccccctaaggtacctaaggtaagatctccccaccccccaaatcccgctggtttcttttccagtgccaggttgcatgatcaggtcccatctcctggggttgttggtgtttgtttgtttgtttgtttgttttttccatctattgatcattagtttagaatagataacatgaaccagttctggagccactactaggaggaacgcaagctcttcactgcaatcacacagcaggaaagaaagagataactcaattcttccgtggtgctgggcctccaaaattcaaagaacttggcacaactgaagcactaaatttgtatcctccatgcttctcaatcattttggacttatgggctgctcttctttgattggccagagttgctatgtcttgtaactgttttctttgttcttcattaagactgtgtgagtcagagcctgataccacacaggattacgattttgaatagtttgaaagatagctttaaatatctgatactcatcaacagggttatcttcatcatcaatgattgtggaatagctttccagagcagtctcttcagcatcaccttcttcccaatcttcatcacctccatcttcacctgcctgcttagccagaatctccaaatattcttgctcatcttcatcaatataatcttcatcactccccagttcctcggtttcatcatcatcttcagcttcatcatcatcatcactgtcattcccgtgttctgcatggcaggcatatgctcttttaaatccgttaaatctactgaacaagagcatagaagatcttgaatatttgtttctgattgaggacagactgatcagactggtcagaaagaagctggataaaatgatcctttagaactggcagaaaatgttgcattgcctcctagtctggtctgtctgttctaaggtgaatttaccttggtcctgcagtgttgacaccgtgtttccaatcttttgtatttccttagggctcctcaaccctctgtgaaaggtgtggaggtacaaagaaatgttaagtcaagtcgccaggcaggtgatatcagttccctgcagaacaatgtgtgtaatagctgatgggtgagtccccttccccatccctttccctctctgcatctgcctcctggataatctaagctactttcttatctcctaattggatgacaacaggggggccagggttgcctcagggataatagaggcccttggttttggtggcctattgttgtgcatctggaaagcactaatgcttaggtttttagtcctagtaccaagtcagaaaaacatgaaagaggaggaaggaggatttagatttagcaatcaagagctagaatagaatttttacattactcccaaaacaatactgctgccttacttttcttcaatatatgtaaagtgcaaaacgaaaaagttaattgttacaccaacattttatatcatatatatattatatatgtacttgaaaaatcaatgtgaaatacaaatcttttgcgagaagtgaagactaagagaggttgttaccagcagaatagtactacaaataatgctaaatgaagttctttaggttgaaggaaaatgagattcaatggaaatttttatctacaatgaggaataaagagcagcagaaatgttaaatatgtaggtaagcataaaatattaccttttattttctcttaattataaaaaggaaaactaaagcaaaaaaattctattgtggagtctataatgaatgtagaaataaaatatatgttcacaactacacaattgagagacgtgaatgaatttttactattgtaaatgtattatgttttatgtgaagttgtaaatattaacgttaataggctgtgataagttaaagatgcatatggtaacccttgagcaacccctaaaattaataccaaaatttattattaaaaagataatagaggaagaaacatggcgatgccgacgttgactgcgaaactgtactccctgctgttccgcaggacttccaccttcgccctcaccatcgctgtgggcgtcctgttcttcgagcgagtcttccatcagggcgcggacgagatctaccagcacatcagcgaggggaagctatggaaacacatcaagcaaaagtatgagaaaaagtagttccttggaggcccccatccaggccagaaggaccaggtccactcgccagctgtttgcccagagttggggcctcagcttgaagacgatgctcaagttacttttcatgtaccactgttcactgttggcaagaaacagctttacctacagaacagactctttaccttctgccgtgtttgaagtatgtttagtcagcatcatcaagaaataaatgtgaattgcccttgaaaaaaaaagacaatagaggtattgaaataaaatactaaaaatgtttgattatccccaaataagtgaggaatgtgagacagaggaataataaacaaatgagacaaaaagaaaacaaatagcaaatgacagactgaatcgcatctataattacattaaatagaaagagactaaacactccaatagaaaggcagagattattagataggataagaaagcaaggcccaactatttgctaacaaaaagagatgcatttacatataaaaacttaaatagattgaaaataaaatgaagaaaaagcaaaatacaaacctaagaatactgttttggctatataaatatcagacaaactagaccaagaaaaagaatatcacatgagataggggtataaagatagtacattaataaatagtaatgctaaatatatatgtgtctaaaaacagagcctcaaaatttatgagacaaatgcagacagatctgaagggagaaagagacatatctaaaatcataattgatgatttttatcactcctttctcggtaattaatggaagaactaaaaaaaatcagtaaagatttaaaatatttctataatactgtcatccaaattaatgtaattgacattttataggacactactcctaattgctgaagaattcctattatttccaagggcacatggaatgctcatcaaagtaaattatattctgtaccataaaatatgtatccataaatatcaaaagtttgaaatcttacagagtatgttctctgaccacaacaaaatttaattagaaataaacatgaagtatctagaaatatctgtaaatgcctccaaatatttataaatgaaataacatatttgtaaataagatgttaatcacccagcactttgggaggccaaggcaggtgatggtcaggaattcgagatcagcctggccaaggtggcaaaacccctctctactaaaaatacaaaaattagccaggcatggtggtgtacacctgtaatcccagctactagggaggctgagagaggagaatcgcttgaacccggtaggaggaggttgcagtgagccgagatcgtgcaattgcactccagcctgggtgacagagcaagactccatatccaaaaaatatatatgtattttatcagagatgaatataaagtatatattttatcagagataatttgaaaagattaataaaaattataaattcctagagagaatgtccaaggaacaaagaaagagaaaactctggtaacaggaataaaagagtgtacatcactacagatttgatggatattagaagattgataacagtatattctctgaccacaacaaaattaaattagaaatgaatattactataaaaataaagatttcctctgagaatggcagacatattttttcctcagttatatgtctgattagcctatgtacttattgatttgatcccatattagttgagtagcacaaaagagaatggggaaagatgacattgtgggaattgcctggtaaagaggatttataggactgtcatagcattgataactgagagaagatgcgattgagggccatagtctttctagtactgccacagtatgtgggtggatagctaaaaggcacacacaatagagcgatgctatatgaaagccaccagttggaggacagtggggagtggtgaccaaatcttgcaaggtattcaatgtttagggaagttacattgaggtgagcccctcatcaataaggcattagtataattacaacccattctcgttaagcctcaaatgtggtctaaggaagaagttacatcaataagagagtgggactggaaaattcatccagttgagtaaagagttgcgtgtccctttttttgtctttccatatcccacaacaccacagaggggaaagtaagtgtctagaagggaggacaacaaagggagggaatgtacagtccttgacgtcttcatctcctttacgcgttatgatcttgaagtcacagcctgatctagcatgacctgaggtaggcaaggagatctgagatttacatcaagttcaaaaatcaaattgtaaaataaatgtgactgacttacatggcacatatatttactatatttataagtaaataattatatgagatcattctaataatatcaccaccaactaataggatgtggccaacccacgcaagtgtaaagggcatgttttcaactttcttagatggagaacagtcaatggaaaaaataacatcatgttttatgtttgcactctaatgagttgagaatccttaatatattcacttacagttgaagtttgactttatctcaactattatttctctttgcatccctgtccttttgcttgctcttcagcttgcccatttctcttttctctgtatttagtccttcatctcctcttctcaatctttattatccttcataatctctcctcttcctgcatctttccacccctcctacacttaaaattttattacatcctcctgtcattcctcttactcctctcttctgcctgatttctactacttctctgcatgtattggacctctacttagagttaatcatataatttatcgaccaagtggtgtcacttttgaaagtaaatgaaggtgctatttgtaattttgctaaggcaacaggtacaaaccagtactgtcctaggaaaactgggatatatggtcacgctagctgtagtaaagccccaatttagggtccagatgggtagggaaggtcattatgagaaaatgatattaagtcaatttctgtaggatgtgtaagagccagatgaagagtggggagaagcatattactggcaaaacaaatgagagtacagaggcgctgaggtgagaatgaaggaagttcaaagtagctggagaatggaaaaagatgggaaaagtggcataggctgaggctgccgatgtggataataatgaggagccagatcaggacaggaattgaaaaatggacatccagaattcctgtacatgggggaagggaacttagatgaggctttctggttgaaacgagggcaatagattatttgtcaacaaagttgcatttttataacaagcataggaattctatatagaattgcatgttacaggtcaataaaaatatcactgttttaaaaagatatttatattatcaaattgcatgacctaaggaagcaagaattcttattgaagaatgttattaatagttgaaatgaagtgatggtgaggaatggagatgaagaaaacagaagggagagaaggttaaagccctgccaaagccattgcttggccagggttaggagttgacttttattctaattgcaatgggaaggcaataggagatataagcagggaaatgacatgattcgatttacattttttaaaattttactttaatttctgggataactgtgcagaaggtgcaggtttgttacataggtatactcatgccatggtggtttgcagcacccatcaacctgtcatctaggttttagccccgcatgcatcacgtatttgtcctaatgctctctctctctttgcccccaccctccaacaggctccagtgtgtgatgttcccctccctgtgtccatgtgttctcattgttcatctgtcatttatgagtgtgaacatatggtgttggttttctgttcctgggatagtttactgagaatgatggtttccatcttcatccatgtccctgcaaaagacattaactcattctttttgatggctgcatagtattccatggtgtatatgtgccacattttctttatccagtctatcagtgatgggcatttgggttggttccaagtctttgctattgtaaatagtgctacaataaacatatgtgtgcatgtgtcattacagtagaatgatttataatcttttgggtatatacccagtaatgagattgctgagtcaaatagtatttccggttctagatccttgaggaatcgccacactgtctttcacagtggttgaactaatttacactcccaccaacagtgtaaaagtgtttctatttctccacatcctctccagcatctgttttttcctgactttttaatgatcgccattctgacttgtgtgacaaggtacctcactgtggttttgatttccatttctctaatgaccagtgatgatgagcttttttaaaatatgtttgttggccgcattaatgtcttcttttgaaaagtatctgttcatatccttacgtttgtttttttcttgtaaatttgtttaacttccttatagattctggatattagacctttgtcagatggatagattgcaaaaattttctcccattctgtaggttgcctgttcactttgatgatagtttcttttgctgtgcagagctctttagtttaattagataccatttgtcaattttggcttttgttgccattgcttttggtgttttagtcatgaagtctttgcccatgcctatgtcctgaatggtgttgcctaagttttcttctagggtttttatggttttaggtctaacatgtaagtctttaatccatcttgaattaatttttgtataaggtgtaaggaagggatccagtttcagttttctgcatatggctagccagttttcccagcactatttattaaacagggaatcctttccccattgcttgtttttgtcaggtttgttgaagatcagatggttgtagatgtgtggtgttatttctgaggcctctgttctgttccattggtctatatctctgttttggtaccagtactatgctgttttagttacggtagacttgtagtatagtttgaagtcaggtagcatgatgcctccagctttgttctttttgcttaggattgacttggcaatgcaggctcttttttggttccatatgaaatttaaagtagttttttctagttctgtgaagaaagtaaatggtagcttgatgagaatagcattgagtatacaaattactttgggcagtatggccattttcatgatatcgattcttcctatccatgagcatggaatgtttttccatttgtttgtgtcttctcttatttccttgagcagtggtttgtagttctccctgaagagttcctccacgtcccttgtaagttgtattcctaggtattttattctgtttgtagcaattgtgaatgggagtttgctcatgatttggctctctgcttgtctattattggtgtataggaattcttgcaatttttgcacattgattttatatcctgagactttgctgaagttgcttatcagcttaaggaatttttgggctaacacgatggggttttctaaatatacaatcatgtcatctgcaaatgaagacaatttgacttcctctcttcctatttgaataccctttatttctttctcttgccttattgccctggccagaacttccaatactatgttgaataggagtgatgagagagggcatccttgtcttgtgccagttgtcaaagcgtgccagcttttgcccattcagtataatattggctgtgggtttgtcataaatagctcttattattttgagatatgttctatcaatacctagtttattgagagtttttagcatgaaggggtgttgaattttattgaaggtcttttttgtctctattgagataatcatgtggtttttgtcattggttctgtttatgtgatagattacgtttattaatttgtgtgtgttgaatcagccttgcatcccagggatgaagccgacttgatcgtggtggataagctttttgatgtgctgctggattcagcttgccagtattttattgaggattttcacatcgaggttcatcagggatattggcctgaaattttctttttttgttgtgtctctgccaggttttggtatcaggatgatgctgtcctcataaaatgagtttaggaggagtccctctttttctattgtttgcaatagtttcagaaggaatggtaccagctcctctttgtacctctggtagaattcgtctgtgaatctgcctcgtcctgggctttttcttggttggtaggctattaattgctgccttaatttcagaacttgttattggtctattcagggattcgacttcttcctggtttagtcttgggagggtgtatgtgtccaggaatttatccatttcttctagattttctagtttatttgcatagaggtgtttgtagtactctctgatggtagtttgtatttctgtgggatcagtggtgatatcctctttatcatttttattgtgtctatttgattcttctctcttttcctctttattagtctggctagcagtctattttgttaatcttttccaaaaaacagctcctggatttattgattttttttgagggtttttcgtatctctgtaacaagatagttatttcttgtcttctgctagcttttgtatttgtttgctcttgcttctctagttcttttaattgtgatgttagggtgtcaattttaggtctttcctgctttctcttgtgggcatttagtgctataaatttccctcttaacactgttttagctgtgtcccagagattctggtacattgtctctttgttctcattggtttcaaagaacttatttatttctgccttagtttcgttatttacccagtagtcatttgggagcaggttgttcagtttccatgtagttgtgcagttttgattgagtttcttaatcccgatttctaatttgattgcactgtggtctgagagactgtttgttttgatttccattcttttgcatttgctgaggagtgttttaattccaattatgtggtcgattttaaaacaaatgctatgtagtgctgagaagaatgtatattctgttgatttggggtggagagttctgtagatatctattaggtctgcttggtccagagctgaatttaagtcctgaatatccttgttaattttctgtctcgttgatctgtctaatattggcagtggggtgttaaagtctcccactattattgcgtgggagtctaggtctctttgtaggtctctaagaacttgttttatgaatctgggtgctcctgtattgggtgcatatatatttaggatagttagctcttcttgttgcatggatccgtttaccattatgtaatgcccttctttgtcttttttgatctttgttgatttaaagtctgttttatcagagactaggattgcaactcttattttttttgccttccatttgctttgtaaatatgatttacactttaaagcaattgctgtaggtactctgtggagaactgattgtagaaggggaaatatttgaagtagggaggtcacttaagagactcttatgccagtggcctcaactaggatgatatagagataagttgatatatatttgaggtagaatattaaggattttgtggtatttttaatatgggataagagatcaggtaaagtaagcagtgatggaagactcataaatttctggtttgggaatctgaatgtatgtcggtggtattcactgagttgaaaaagtcaagtgaaggaatacataatgtttgtgagaaggatacattataagatatcaatatgagacatgttaattttgaatgtactgagagatttccaattatagaatggagataggcagttgcattatgggtctaaaaatcataggccaagttagtagaggagatacagatttgggagcaggaaacataaaatggtgttttaaacctcctttcctgaacctgtttacatttcactgtagagacattacagaggaagtgctgaggaaaagcatgcacctgaaagggaggttgctatgcaacagatgaggaaagtcattcagccaggcagaattgaagttggcctttgggaacaaaatgctgccgtccttcctagcattagttgcctttcatatgaaggcttctggcatgagttgatgccagaacaaatgtgaactgcacaaagatctgtcttgaattttggaaaagtatcagtttaatttgagtcagctcacatctgtatttaattttctgcctttttgagtttctccagttatcctggaagcatagcagcatgtgcgtccttgggtaggacccaattactgtgcattccactttgcacattgagaaaccaagctcagagaattgagtggcctgagcgggctcacacatcttgagacagacaggctgggcactccatccctggaattctgatgcccagcgcaggttctctccataagaccacagctgccccaggccccagctctgaaaggaaccagggcttgccatggctcagacacataggtctgattgtcctggctcttccagtgggcaccaggaaggcctcagggacattgtgattgtgtccctgataaggaagaggcctgaggttctgagtacagagtggataccaaggagcaattctcatgcctggatggacccacacagggcagggggagggtgggggcctctgcttgtgtcctcctgaatgcagagcatgagcttggacctcctagaacacaaacgttgcttatttggagcaaatgttggggtggaggaggtctgtcattcaaatgggaagggtgcctcggtccccaggccagcatgagcagaatgtgaactttggagttaggacgacccaggctcaaacttctttttgtaatttcaacttttattttcgatttaggaggtaaatgtgcaagtttgttacatgggtatattgcgtgatgctgaggtttggggtatgaatgatcccatcactcaggtaatgagcatagtacccaataggtaattttttagcccttgccccacttaatttatccattctctagtagtccacagtgtgtatttttaccatctttatctccatgtgtactcaatgcttagctcccacttatacgtgagaacatgaggtatttggttttctgttcctgcattaattcacttaggataatggcctccagttgcatccatgttcctgaaaaggacatgatttcattatgctttttgtggctctgtagtattctatggtgtatatgtaccacattttctttttttttattattattatactttaagctttagggtacctgtgcattatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaatttccacctatgagtgagaatatgctgtgtttggttttttgttcttgtgatagtttactgagaatgatgatttccaatttcatccatgtccctacaaaggacatgaactcatcattttttatggctgcatagtattccatggtgtatatgtgccgcattttcttaatccagtctatcattgttggacatttgggttggttccaagtctttgctatcatgaatagtgccgcaataaacatacgtgtgcatgtgtctgtatagcagcatgatttatagtcctttgggtatatacccagtaatgggatggctgggtcaaatggtattttcagctctagatccctgaggaatcaccacactgacttccacaatggttgaactagtttccagtcccaccaacagtgtaaaagtgttcctgtttctccacatcctctccagcacctgttgtttcctgactttttcatgattgccattctaactggtgtgagatggtatctcattgtgcttttgatttgcatttctctgatggccagtgatggtgagcattttttcatgtgttttttggctgcataaatgtcttcttttgagaagtgtctgttcatgtccttcgcccactttttgatggggttgtttgtttttttcctgtaaatttgtttgagttcattgtagattctggatattagccctttgtcagatgagtaggttgcaaaattttctcccattttgtaggttgcctgttcactctgatggtagtttcttttgctgtgcagaagctctttagtttaattagatctcatttgtcaatttgggcttttgttgccattgcttttggtgttttagacatgaagtccttgcttgtgcctatgtcctgaatggtaatgcctaggttttcttctagggtttttatggttttaggtctaacgtttaagtctttaatccatcttgaattaatttttgtataagatgtaaggaagggatccagtttcagctttctacatatggctagccagttttcccagcaccatttattaaatagggaatcctttccccattgcttgtttttctcaggtttgtcaaagatcagatacttgtagatacatggcgttctttctgagggctctgttctgttccattgatctatatctctgttttggtacacattttctttatctattacactactgatgggcacctgggttggttccatgtctttgctgttgtaaatagcatggtaatgaacttatgaatgcatgtttcttttaggtataataatctattttcttttggatatatatctagtaatgggattgctgggtcaaattgtagctctgttttaagttctttgagaaatgtccagctctgttttaagtcctttgagaaatatctagactactttccacagtggctagactaatttacattcccaccaatagcatataagcattcctttttctctgcagccttgccagcatctgttgtttttttaactttttaataacagccattctgagtggtgttaaatggtatctcattatgattttgatttgcatttctctaatgatagtgatgttgagcattttttcgtatgttctttggccacttgtatgtcttcttttgagaagtgtcagccaggtgtggtgacacatgcctgtaatcccagcactttgggaggctgaggagggcagattgcttgagtccagcagttcaaggctagcctaggcaacatggtgaaaccctgtctctacaaaaaacaaaaaagttagccgggtgtggtgatgcacacctgtagttccagctgctcaggaggctgaagtgggaggatcacttgagcctaggagattgaggctgcactgagccataattttgctactgcactccttcctgggtgacagagtgagaccctgtctcaaataaacaacaacaacaacaacaaaacacacacacacaaaaacagagaaatgttcatgtcctttgcccatcttaaattttttttgcttgttgaattatttaagttccttgtagattctggatattagacatttgttgaatgcatagtttgagaatactttcacctattctgtaggctgtttactccgttgataatttcttttgctgtgcagaagctctttagtttaattaggtcctacttgtcaatttttggttttgttgcaatttctattgaggacttttagccaataattctttcccaagatcaacgtccagaatggtgtttttaaggttttcttctaggattcttatcgtttaaggtattgtatttaaatctttaatccatcttgagctgatttttgtatatggtgtaaggaacggggtccagtttcaatcttctgcttatggctagccagttatcccaacaccatttattgaatagagagttctttcctccttgcttatttttgtcaactttgttgaagatcagatggctgtgggtgtgaagcttcatttctgggttctttattctcttccattggtttatgtttccgtttttgtaccagtaccatactgctttggttactgtagccttatagcatggtttgaagttggggaatgtgctgcccaggaccaaattttaaattttgtttactagctctgtggctttgtctagttcatgcaatatgtatgtctatgcctcagcttcttgtctgtaaaatgaagatgctgacatccacttcccagagctgctatgagaggaagacaagccccataacagatcctgctgtgatatccaagtctgccttgcccttctgtccttccccagcacacacaaaataagttcattgctgggcctacacaacaggcagggaagatacaggcaattcatgagtgaggtgctcatgtggaggcactcggcccccatttatgcgtcttctctcagtccttgcttttcctcagccctagagctgaggagtttttcaagaggtatttgatgtagcacttgtttcagttagaggccctcataaagatctcttttagagaagcagctgatatcttctactggccaccttgtggaaagtcctgtggttcacagtatttcatgttgttgacactcagcaaagatactgcctaaggaggctgatccatggcaattggactcacagaagtaattatagaacagaagccaatttattaacataaactcattttgactgcctggtgctcactcttgtgcaccttctctcccaataaaggaaaacagtcacaggtaacttgagggaggggaattgatggtcatgtcagtggctggaattcttgagttaaaattttccattcacagaagcttttacatggaatgtctggttacaaattttggtggtctgcagacaagttagtttgtctatgttccaagtttgaagcatgaagaaacagaaaaaccaaatagaccaataataagtaaagacattggatcaataagaaagcctcccaacaacaaaaggccagggaccaaatagcttcatttttgaattctaccaaactttaaaagaaaaactaatatcaatttatctcaaaatatttccaaaaattgaagatgagggaattctccctaactcatcctataagcctagcattaccctgggcccatacaaaaatcaaaatcagacaaggcccccccccaccccaaaaaatgaaattacagtacaatatttctgatgagtactgatgcaaaaatcctccacaaaatattagcacactgaatccaacagcatatcaaacaggttattcactatgagcaagctaaatttattctagggatgcaataatggttcaacatgcacgtatctataaatgtgacaaatgtgacacataacattaacaaatgaaggatgaaaagcatatgattatctcaatagatgtggaaaactcatttgacaaagttcagcatctcttcacgataaaaaacctctcaacaaattaggcataaaaagaacattcctcaaaaaaatgaaggccatatatgacaaacccaccactaacattatacttaatggagaaaaatagaaagtctttcctttaagatctggaacaagacaagaatgcccatgtacaccacttttgttcaacatagtattggaaatcctagctagagcaattaggcaagaaaaagaaataaagagcatttatattggaaaaaaataagtcaaattgtccttgttttcagatgacataatcttatacttagaaaaacttaacaaccccaccaaaaaaacttgaaactgataaatgaattcagtaaagaggcaggatacaaaatcaggactcacaaatcagtagcatttatatataccaacagcaaacaatctgaaaaaaggaatcaagacatcaattccatttacaatagctataaaaatggaatacttaagaattaattaaacaaagaagtcaaagatctctgcaatgaaaactataaaacaccgatgaaggatattgaagaggacacaaaaaacggaaatatatcccatgtacatggattggaagaattaatattgttaaaatgtccatactacccaaagcaatctacagattcaatgcaatccctatcaaaataccaatgtcatccttcacagaaacagaaaaagtaattctaaaatgtatatggaaccaaaaaagaccttgaatagccacagtgattctgagcaaaatgaacaaagctggagacatcacattatctgacttcaaaatatactccacaggtataactaaaacagcacggtactggcataaaaacagccacatagaccaatgtatcagaatagaaaacccagaagtaaatctatacatttacagctaactcatttttgacaaagacatcaagaacaaagacgtaaatatcaaacctgaaactatgaaacttctagaaaaaacacattggggaaatgcttcaggacattggtcttggtaaaacttttgtgtaggacctcaaaagcacaggcagctaaagcaaaaatagacaaatcgaattatgtcaagctaaaaccttctgaacagcgaaagacacaacagattgaagaggcaacctacagaatgggagaaaatgtttgcaaactattcatgtgacaagggattattaaccagaatatataagaaactcaaagaactcaacagtgaaaaaaacaaataatctgatcttaaaataggcaaatgatctgaatagacatttctcaaaagaagacattcaatggcaaacagatatattaaaagtactcaacattgctaatcatcagggaaatgaaaatcaaaaccatgaggcataatctcatcccagttaatactgctattaccaaaaagacaaaaagtaacagatgctggcgagactgtagagaaagggaaactcctgtatattgttagtgcaaatgtaaattagtacaggcattttggaaaacagtatgtaggtttctaaaaaatctaaaaataggaataccatatgatccagcaatcccactgctggacatatatccaaacaaagagaaatcatatcagcatgcccatgtttactgcagcactatttgcagtagccgagatataaaatccatctaaatccccatcaatagatgaatggataaagaaaatgtggtgtatttatacacaattgaataatattcagccatcaaaagaatgaaatcctgtcatttgaagcaacatagatgaacctggagggcactgtgcaacagatgaatggagaaacaaatgtggtatatccatacaatggaatattactcgaccataaacaggaacaaagtacgattgagtcttgaacaatggtcgggggtggggctagctgtgcccatcctccacacagttgaaaactcacgtctaactttagactcccccaaaacttaactgctaatagcctactgttgactggaagacttactggtaacataaacagttgattaaaacctattttctgttatatatattatatactctattcttacagtaaaataagatagagaaaagaaaatgtaattaagaaaatcataagaaagagaaaatatacttactatattttaccacaataaaaaataaacttaaaaaatattttagtgggcctgtcagcagccaggtcatcctctcacagctagactgcctcagacaaaagtactacacatattttttgctgcttagatgtccccttcatagattccatacagcccacctccctccttcctacacagtcctttctttattttttagtgtaattattaagttttaattgagatatttatataactttttactttacagatcatttactctctttccaggcatcaaagaatcatttataaaaatttattttataccaactcacaaagaaaacctcaaaaaattcccaaaagtagaaagtataaaacaaccttctctgtgaccacaatgccaaaagcaatctagagcaatgctgtttaaaagaactttgtgtaatgatggaaatagtccatatctgcagtgtccaatatggtgatcactagccacatgagactagtgggcacttgaaatgtggctactttattggagggactgatttttaacttttagttaattgtgattaatctgaatgtaactagccacatgtggccagtggcaaccatattggacagggcaaatctaggaaattagaacaaaagttaaacagaaaccatacttttaagttaaaaagcacttgtacccacaaataaaactgtgcatacacatatacatgcacactctcacacatgcacttcaaagtaactattgaattaaagagaagagcaaatccacagggcacttagaaaatgaaaacattgcatatatcaaagcaaacaggatgcatataaaactacatattcatagtattaaatattttcttccttattaaagaaaaagaagcaaaacaagtgaactagacactacaatccagacatcaaagataagcacagaaaccttttaatgaaaatcagaaaactagaaattatcataaatccaggagctgatcatttggaaaaaaaaaaatggattttttttttttttgtaaatcacatgaagaaaaaactgaaattaaaataagaaattataataggatgtacacttttatataaatatacaatgtgatataaaactattctaataaatttaaaatcttgatactaatcaaattagaatcaaatcagaatattagcaaaaactacttgagaaataaaaagaaataaaaaatttttgaaattctaatttttattttagatacgggggtacatgtgatttgttatatgggaatattgcatgatgctgaggtttggagtattgatcctgtcacccaggtagtgaacatagtgtcaaataggtaggtttttaacctacccttcttctctccatcctctagtattccacagtgactattgttcctatatttatgtccatatatattcaatgattatcttccacttctaagtgagaatatacagtatttggttttccattcttgcattaatttgctcaggattatggcctgtagctccatcgatgttgctgcaaaggacatgattttatttctatttatggccgtgtagtgttccatggtatatatgtaccacattttctttatccagtctaccattgatgagcacctaggttgattccatatctttgctattgtgaatagagtggtgatgaacatatgaatgggtgcttctttttgatataataatttattttcacctcgcagagatacaacaaaaaaaagagaaaacttcaggccaatatccctgatgaacatcgatgcaaaaatcgtcaacaaaatactggcaaactgaaatgagcagcacatcaaaaagcttatttaccacgatcaagtaggctttatccccaggatgcaagtctggttcaacatatgcaaatcaaaaaatgtgattcatcccataagcaaaactgaagacaaaaaccacacgattatctcaatagatgcagaaaaggcctttgataaaactcaacatccctttatgttaaaaactttcaataaactaggtattgaagtaacatacctcaaaataataagagccatctatgacaaacccacagccaatatcgtaatgaatgggcaaaagctggaagcatttcccttgaaaactggcacaagacaaagttgccctctctcatcactcttattcaacatagtattggaagttttggtcagggcaatcaggcaaaagaaagaaacaaagggtattcaaatgggaagagaggaagtcaaactatctttgtttgcagatgacatgatcctatatctagaaaaccccatcgtctcagcccaaaagcttcctaagctgataagcaacttcagtaaagtctcaggatacaaaaccaatgtgcaaaaattgctagcattcctatacacaaacaacagggaagctgagggccaaattatgattgaactcccattcacaattgccaaaaaaagaacaaaatacctaggaatacagctaacaaggtaagtgaaggacctcttcaaggagaactacaaaccatggctcaaagaatcagagatgacacaaacaaatggaaaatcattccgtgctcatggatagaaagagtcaatattgtgaaaatggcgatactgcccaaagcaatttatacattcaatgctatgcccattacactaccattgacgttcttcacagaattagaaaaaactattttaaaattcaaatggaaccaaaaaagagcccaaatagccaaggcaattcctaagcaaaaagaacaaagctggaggcatcgtgctatttgacttcaaactatactacagggtgacaataagcaaaccagcatggtactgctacaaaagtagactaatggaatacaatagtaaactcagaaattagaccacacatctacagccaactgatctttgacaaacctgttgaaaacaagcaatggggaaatgattccctatttaataaatggtgctgggagaactggctagccttatgcagaaaattaaaactggaccccttccttacaccatatacacaaatcaactcaaaatggatccaagacttaaatgtaaaactcaaaactgtaaaaaccctagaagaaaacctaggcagtaccattcaggacataggcatgtgcaaacatttcatgatgaacatgccaaaagcaattgcaacaaaatcaacaactgacaaatgggatgtaattaaactaaagagcttctgcacagcaaaagaaattatcaacagagtaaacagacaacttacggaatgggagaacatttttgcaaactatgcatctgacaaaggtctaatatccagtatctataaggaacttaaacaaatttaaaataaaaaacaaacaacctcattaaaaagtgaaaaaaagacatgaacagacacttctcaaaagaagacatacatacatacatgcagccaacaaacgtatgaaaaaaatcttcactgttcattagagaaatgcaaatcaaaaccacaatgagataccatttcatgccagtcagaatggctcttattaaaaagtccaaaaacaacagatgctagtgaggttgcagataaaaaggaatgcttttatgctgttgttgggagtgtaaattagttcaacaattgtggaagacagtgtggtgatttctcagagatgtagaggcagaaataccacttgacccagcaatctcattattaggtatatacctaataattaccatatatatatatatttctattataaagatatatgcacgtgtatgttcattgcagcactattcacaaatgcccatcaatgatagactggataaagaaaatgtcgtatatacaccatggaatactatgcagccataaaaagaagtgagacaatgtcctttgcaaggacatggatggagctggacgccactgtctttagcaaactaatgcaggaacagaaaaccaaataccaaaaaccgtgttctcacttataagtggaagctaaatgatgagaacacatggacacatgggggaggaaataacacattggggtctttggagggtcggggatgggaggagggagaggatcaggaagaatagctaatggatgctgggcttaacacctaggtgataggttggtctgtgcagtaaacaaccatggcacacatttacctacgtaacaaacctgcacatcctttacatgtaaccctgaacttaaaataaaagttggaaatcaaaaaaaataattatctattttcttttgggtatgtgataggattgctggttcgaatggtaactctgttttaagttctttgggaaatgaccagactgctttccatggtggctgggccaatttacattcccaccaacagtgtataaatattcccttttctctgcagccttgccagcatctgttatattttgacttttaaataatagccattctgactggtgaaagatggtgtctcattttggttttaatttgcgtttctctgatgattagtgatgctgaccatttttttgcgtgtttattagctgcttgtatgtcttattttgaaaagcgactgttcacataatttgcctatttttaatggggtttgtttttttgctccatgcagttttttctcatacaaaacacagtgtcattatattaggtattaatatcaatatagctttacctcctccacatgagaatctggccactggtgggaggagtgtcctcaggcttcccacatctacaaatgctctctaggattaatcttaaagataattttattccttaaattgtggtttttcctcaccctttcctaatgccatgaaaatattactcaaaaagatgtgttttttttttgtaagagcagaaaagtatgctaactgtggatttacattctttgtaatataataaaataattccatattgttggacattcaggtattttccaatttttacaattgcatatgaagcatgaatatttttacttttaaatattaaagtaaatctctgattgtttctttgcagttaattcctaaaactggaatcattgatatgtgaccatatgaacatttctaaagctttcatcaatacatttctctccggaatagctgtaccaattcataatgctacagctatgtgtgaatgccagttctactgcattatcatcaacactggccactattctctaaatatttgccgacctcatattgtttttattttgagacagagtctcactctgttgcccaggctggagtgcagtggtgcgatcttggctcactgcaacctctgcctcctgggtttaagcaattctcgtgcctcagattcccaagtagctgggattacagatgtgcaccaccatgcctggctaatttttttgtattcttagtagagacaggatttcaccatgttggccaggcagttctcaaacttctgacctcaagtgatccacctgccttggcctcccaaagtgctgggattacagacgtgagccatcacagctggccgccaacctcgtatttgaaaaataagtgatttaatattgttttatttaaaaatatatttactgccttttaattatagaaaccatttatatttatctaggaaactggaaaatacataagagaatgaagaacaaaataaagtctataatcttacactaatataactactgttatcattttaaatattttgtttacatttagttgtttattcaattatcattgactccttctttctcttcacattcaatatccaaccaatctttcaggaaaatattttggttttatcttcaaaatatatttaaaatttggcaacttattaccagttctatagttatcactctggttccaaccaccatcattgctcatgtggaccattacaatagtattttcactggtgatatggtttggttctgtgtccctacccaaatctcgtcttgaatggtaatcccctcctgttgagggagggacctggtgggaggtgattggaccatgggggtggtttcctccatgctgttctagtgatattgagtgagttgtcacgagatctaatggtttaaaagtgtttggcagttccccccttgctctctctctctcctgcagccatgtgaagaaggtccttgcttcgctttcaccttccactatgattgtaagtttcttgaggcctccccagccatgcagaactgtgagtcaattaaaccttttttcttcataaattacccagtcttaggtagttctttatagcagtgtgaaaatggactaatacaactggtctccttactttgaccctgtctcaggcagtctcctctccacacagcatctggaggtatcctgtgacatcttatgtcacttctctgctcaaaatctttccatatttcttatcaaactcagaggaaaattaaagttgttacagtggtttataaagtctaactggattcatttatcacctctatgatctaattgcctcaccgtctcatccactccactgtagccatattggcttccttccagatccttaaatataccaggcttgctctcccactttaggtatttttctcagctgttttcattgacagaaatactcttccataatacagctgcatgactaattccccccattagctcaagtgagcaccccaagaatattctgatcccctttgttatgctctatttttctcttctacacaactcttattttgtaatgcactatatggttatttacagaatatttcttccactagaaaataagattcaaaagggaagaaatatttgggtgttttgtcttatgtttctgaagaacattaaacaaggacctgacacatagaaggcacttagtaaatattttccatggtctacagtgaccataaagtcataacaaaccaattgcttatgagagatacaactgttcctgctaataatacaattcctttgttttgatggcaaataacatccttaataacagtgatttgcttatcagtaaaacatggatatttgtaccaatctaacttacaggtttgtcataagaactaaaatagataacatatttaaagaacttactgctttgcacatagtatacactcaataaatgttagctacactattttatagtgcttatgagtgctttgctcaggagttagtcctgggtttatcatctctttcttccactactggttacatggtattggtcaatttacttaataatgtatatacaaggggatattattcagccctagaaaaaaagaaaatcctgccctctgtgacaatatggttgaacctggtagacattatgctaagtgaattaagctagacacagaaagaaaattactgcgtaatcttatttacatgtggaatcttaaaaagttgaattcatagaagcagagagtagaatggtagttacaggaggaggggaagaatgggagatggtggtcaaagggtacaaagtttcaatggtgcagaatgaataatttctagcgatctaatgtacagcatggggacagtagttaatacctatgtggatatttaaaatttgctaaaaggttagatcttgagtattcttaccataaaaatgtaactatgtgaagagatagatatgttaattagcttgactgtaataatcagtttactgtttatttatatcaaaacatcacactgtacatattaaacacacaaaattttaagttaaaaacataaatgttatatgtttttaccacaatacaaaaaaaaaccaaagaaaaaaacaggcaattttttgtgtgcgaaatccagagaagggacagagttaatgagttttcctgtagttctagaaattattgaaaaatggagaagatacaaatcaagattatctaaatgtccaaagttcaaacatgtggggtacatatgataattaaatacattcacataatttgtaaaggtcaagtcattgtaattgggatatccatcaccttaaatatttgtctttatgctggaaagatttgatatatgcatataatctaaaagattcaaaagcagaatcttgaagagatatttgcacactcattttcatagcaattctattcacaatacctaatgagattggaagtattcttctagctgttttggaatatacagtagattgtacagacagttaccctactgatctatcaaacactaggtcttatttcttctatcaaactgtatatttgtaccctttaatcaacctctcttcatccacctctcccccatatgctccctggctctggccatcaccagtatacactctatcttcttatgttttcctctttaaattggctgctagaaacttagggtcatatttgcggttcacctaatggtgttccttctgtgttttaacttcttaatattgattttatttttttctacccatttcccttttgtcttaattattttcaaatgttaattacatgttgtgtgaatcatatgcattctcaaagcaaattttaaaataattacaaaagtattaaagtgcatataattacatatgcacttacatataatcaaataaatattatttaagccaaaacaatgagatatttttcagctaccaaattgtcgatagttaaaaattattcagtgctataatgaatacagcgtatgacactattatatgtttttagtgaaaggaatttagcaatatgtgttaaatgtggccaaatatgcaaaaagttcaatgttgcattattgaaataaaataaaaggcaataaagaaattgttaggcaacatatgacgattcttaccctctagtattgggcaatcagtcattaaatggtgtttacaaagaaatttgaattgtaaagggagaagccctgattatataatgtgtagcaaataaatatttaggattcggccaggcgcggtggctcacgcctgtaatcccagcactttgggaggccaaggctggtggatcacaaggtcaggagatcgagaccatcctgactaacacggtgaaaccccgtctctactaaaaaaatacaaaaaaaaaaaaaaattagccgggcgtggtggcgggcgaggcaggagaatggcgtgaacccgggaggcggagtttgcagtgagccgagatcgcgccactgcactacagcctgggtgacagagcaagactctgtctcaaaaaaaaaaaaaaaaaaaaaaagaaagaaagaaatatttaggattctgctatagtttggatgtttgtcccctcaaacctcatgttgaaatttgatctccagcattgaaggtggtgctaatgagaggtgtttgggtcactggggcaggtccctcacgaatggttcggtgctgtcctcactgtaataggtgatttctcactctgatagcttccaagagagctggttgttaaaaagggcctggtacctccctctcctttcttgctttctctcttgccatgggatctctgcacacgtcagcttcgctaaccttctgccatgaatgaaagcagtctgaggccctcaccagaagcagatgctggtgtcacgctacttgtgcagcctgcagaaccataagccaaataaacctctcttctttataaattaatagcctcagatattccttttgtagcaacactaaatggactaaagtagattcaatactggataatatattatcttgcgtgcaaaatttttttcttaaatgttgagaagactatccaaaaggtattgaaatggttatctatgagtggctggattctttatgctttccctgtattcccaagtgtttatatatgaaacaaatttcctttacagtctaaggcaaaaataatttactgaatatatgtataagacaaaactccttagaggctttgtaaactctcatgcttgtgaacaggatcaagagagcagtaggccgtctccacagagacaatgatgtaaagttgctggagaacagagacagtagaattactccatgtgtatttcacacaaatcttctctgcaaaactcaaatgtcttttatcttttaaatggtagaacaaattctggtaagaggactctatcactctattcaaatccttccttccttccatgctttctctttctttctttttctttctttctttctttctttctttttctttctttttctttcttttttctttctttctctttcttcctttcttccttccttccttcctttctctctctctctttctttcttttcttctttttttctttctctctttctttctttccctttctttttctctatatttgttcacagtttattgaggtataagtgatatacaaaaaactggacatatttaatatatacaatttgatggatttggagatatgcatacatttataagccatcatcacaatcaaggtagtgaacacatccatcacctccaaaattttcctcctgcctcctctttctatattcaaaacctttctttatcattatgtgttcctttcatactaaaataaccttacttgcacctccataaaataaccttatctgcacattggcttcaccaatgttatgggctgtttttaaaaaatttcctttgcaaatttattattgtttaatatctctagattcagaaactgtagacactttgataaatggattgaatttgtttgtctttggtcttcttctcttttaaggtgatatatctagatataatatgtgtgtgtgtgtatgtgtagtgcatgtttgtgcatgtttatcctgtttggtgttttttgagcttcttgaatgtgtggtttagtatctgtcattaatttgaaaagttcttgtccactatttcttcaaatatttcttctgtgacatttattctttcttctctttccagtattacaattattattattattattattttgtgatggagtctcactctgtcacccaggctggagtgcagtggtgcgatctcggctcactgcaagctctgcctcctgggttcacgccattctcctgcctcagcctcccaagtagctgggactacaggcgcccgccaccatgcctggctaatttttttgtatttttagtagagatggggtttcactgtgttaaccaggatggtctcgatctcttgacctcgtgatctgcccgcctcagcctcccaaagtgctgggattacaggcatgagccaccaagcccggccacaattatgtatatgttatatttgttcctattgttccacagttcttgtatgttctactctggtttttttctataattcttttttctctttctattttagtttggaaagattctattggtctatcatcaagttaactgattctattgatggctgtgtccattctattaacaaacttgtcaaaggcattcttcatttctgttgctgtattttttatttgtaaaatttccttttgattctttcttaaaattgccacctttctggtcatgcatgttgccttcttttacgttaaagcctaaatatattaaacattctccccatttcatatctgagtctggttctgataattgatatgtcccttcagagtattttccttcttgcctctctggtgtttcttttcatttttattgttgttgttaaaagctgtgtatggacttctggtttgtggttctgcatgtaaggagcttggaaatccatgccttcttaacaactacaaagctgaataggttgaaaaagtcaacaactcttcttggatctgtaagataggggaggacacagggaaactactactcccaaggttggagatacaggtaaatatagtcatgactcatgagcagaaactgccagaggaaccggtactagggtaggaaaatctaaactgtaattaaataattgctgaaggttcagtgcagacaagtctaagaattaaaaactccaggaggacccagtgatagacgggtttttacagtattatgagatttacctccaggagctcagccatgttgccatagtaaatattggaggaaaatcttctcacgctttcagcagtgggaaggaaaaaggaaccattttgaaatacaccaaagtactcagagtacataaagactaagacttattcataggaccatagaatgcttcttctccccaccccactttaccacattaccaagggcctatttgcagaagttcattttacatagtacatcatgtctcattattaagaaaaaattacaagacatatcaaaaggcaaaaaaaaaaaccccacaagttcaaaagatagggtaagcatcagaaccagatatggcagggtgttgaaattatcagacctggaatttaaaaatgccgagggttctaaaggatgaagtaggcagtatgcaagaagagatgggcaatgtaaacagagaaatggaaatcctaagagagaaccaaaaagaaatgctcaagatcaaaaacattgtaacagaaataaagaatgcctttgttgggtttattagtagacaggatacaactgagtaaagaatctctgagcttgaggatatatcattagaaacttcaaaaactaaaaaagcaaagagaacagaaactgaaataaaacaacagaatagattatccaaaaactgtgggaaaactgcaagggtataacatatgcataatgggaatacaagaaggggaagagaaagaaagaaatataagaaatattggagtcaataatgactgagaatttccctaaataattccagacaccaaaccacagatccaggtggttttgtgtctggcattatttggggagagtctcagttcagagaacatcaagcaggataaatgctaaaaaatgacacctaagcacatcattttcaaactgcagaaaatcaaagagaaaaaaatcctggaataagccaaagggttgggggggattcttatctatagagtaacaaagataagaattacttccaactcctcaaaaaccatgcaaacaagaagagagcggagcaaaatattcaaagtgttgagggaaaaatccaccaacctagaattgcatattttgcaaaattatccttcaaaagtgaaggatgaagactttcttagagaaacaaaaactgagggaatttattgttagtagaccggccttgcaagcaacgttagaagttctttagagagaaggaaaatgataaaggacagaaactctgatctacatgaagaaagtaaaaccatcaaagaaggaataagtaaaggtaaaatgaaaacttttattttacaattcttaattgatctaacagataacagtttgttcaaaataatagcagcaatataatcaattatgtaggtgaatgtatatatcatatatagcttatgtatgcttacatacaagtgaaatgaatgtatctttgatacaaggaacgggagggagaaattaggttattttgttattatgaggtattcacactgcctgcgaagcggtacagtgtcatttgaaaatggacttagattagttgtaattgtatgtccaaaataattgaaaacaggtattaaacaaaaaaacctaaaaacttgtacaccaatgttcatagcagtactagtcacaatagccaaagtaaggaatcaatgaaatttcgatcaactgatgaatagaccaacaattgtggcatatccatacaatgaaatattgatggctggcctcaatggctcatcctgtaatccaagctctttgggaggccaaggtgggcagatcgtttgagcccaggaattcaagaccagcctgggaaacaaggcaaaaccccatctctacgaaaaatacaaaaattagccagcctcataacttggtctcaaaataaataaataaatagatacaaattgaaaaataaaaacatttaaagaaatattgagccataaaaaggaatatagtactaatccatgatgcaacacagatgaacctcaaaaacgtgctaaatcaatgaaaccagacacaaaataccaagtattgtatgattccatttgtatgaaatatccagaatagttaaatccatacagagagaaagtggttagtggttgtcaggtactgaaggagaaggaaatggccagcgacttcttaatgggttcagggtttccttttgtagtgatgaaaatgtttcagagccaggtcaaggtgcttgttgcaacattgtaaatatgctagatgactctaaattgtgcactttaaaatggttattgtatgttatgtgaatttttcttcaataaaaaatttgatgaaaagcaatagattgcaaatttaacatgtgtaaaatctaactcgtgattccctcactgccaaatctgaaatcacagtctttcacactccagttaattgcaaatccattcttctttttcctcaggccaaaaaccttgtagtcatctttgactctctcacactccacatctaatccataggaaactatgaaaggatttacatttctaaatatatccagaatgtgacaacatctcaccattaccacttctatcattctcgtctaaactactataatctccttcactagattttcacaatagcctcttaactggcttcgatcttttcccctcttcagtccttttcagtacagcagccagaggatcctattaaagcatgttatataacataaattttctgttcaaaaccctccagtgattttctgctgctttcagagttaaagccaaagttcatacaatagcctgcagggctctagatgatatgaactaacgtaaaatctgtgacctaatctcctattcttttccccttcattcacattgccccatctgcaccacccttctggctgttagtaaaacttccaggaagaatatttcttcaggaaactgccattgatgtctcctctgtctgaaatatccaccacaactgccatcatcgttaccatcacagccgatatccaaatgattttctaccttacctccctcagttatttactcagatataacttacacagtgagcccatctctaacaaccctacctaacactgtaaccccctcatccttcccagctcacttccacaccttacatttctccttactgcttatcaccattaaaatcctatgcattttatttatttagattttttatctatcttcttcaattataatataaacttcacaagttcaggtaattttacctatctcattcactactatattttcagcacctaacacagtacttggtaaaccatagaagataagtaaatatttgttgagtgggagtggatgaatgacattgtaggaagaatctcctaatggccacctctctgcacaatatggttccataattactgcaggatctccttgcagaaagcctgcctgtcaattccttgctgagctctattctctcacatctagagtagttgtgtttctacctattcaaggaacaatgaggacactacctcacagaagtctggctggtatttattcttctgtggtgaacacctctaaacgaaaaggattttgagttgatctcttgcctatccataaatgggatcaagtccaggggttcagagagaaaagataatggggagcatcaccagagaaaaacctaagtctgttagcatgtaaacattattaattatgtgtatgtgtcttgggggaaaagtgcaagaagagctggataataatttttataagagaagaatgattcatatttgcagcttaatagaagtctgtaatatctagatatgtctgtaatgtcaaagtccagagcaaagacagaatagagataagggaacaggacaaaaggtcatgtttggacagagaagggagactgatttttggaggggcagagatgcatttaactcaagttaaatctagcttatttgtagtttggaaacagcaagaggtttaggccatagtcaaagctatctacatatcttacctgtaaactggaataaatcaaatgcaacttgttcaactgatcactctctctggtattcaggatttgacagttccaaatctgttaccctccagagctgccgcaaaacatcaaagacttacaggtttcagagatactcttccccaattttaaaaaagtagatgtaccacatttcaaatgaaaagagttaggtctaaataaattgttaacatagttcaaagtgtaaagaaaatgtgaaatatgaatattgaaggaaaagctatgtaatgatctttaaataataaagactccctgaacacaacatacatgtactgtttctgtaatctgggtcctactttcctttcagcctcatagcattcctcttcaccacaacgaccacaacttcttttactctagtcacactgaatcactgtgctaatctgctcagaactgcacacctgtgaatgagcctccataatataacttgtgtctcaagtttcacttgttatttttgtcgtgactcagattagcttcggtttccataatagcctgtctcagtcgtttgccttaacctgtcaccacaagaagacaaagacagtagagagacatgttttctcacctgtccctggcttctattcaccaagcttcctgcctgacctgagcaatccagtgggcatgagcagaaaaatgctcatcaaaaagttggattccagcaactttttatagcagctagacccttttctttttcctctgccttttgagactctatacttaaacaaaatagactttaagtaaaaaactgtcactataaatgtaatcacaaaggagattgttacataatgataagagggccaattcaacagtaaaatataaaaattataaatatataagcacatatcatcaaagcacctaaatatgtaaagtaaacgttgtcagatctgaagggagaaatacatagcaatacaatggaagtaggagattttaagaccccacttacaactggggatagataatccagagataagatcaataaggaaaaactacagactgaatagacctaacaaaaatcttcaacaaaatattaccaaatgaaattcaacagcacattaaaagaattatatgccataaccaagtgtaagttagccctaggatgcaaggatggttcaacatactcaaatcaatcaatgtaatacaccacattaatggaatgaaggctacacatcacatgatcatattaatagatgcacaaaaaatatgtgacaaaattcaagaccctttcatgctaaaaactcaacaaactaggtataaaaggaacttaaaacaatacagaccatatatgaaaatcccactgcaaacatcatattcaatgacgaaaaactgaaagctttttctgtaagatatggagcaagacaaggatgcctactcccaccacttcaatttaacacagtactggatgtcatagccagaggaattaggcaagagaaggaaataaaacacatccaaattgggaaggaaaaagtaaaaatatctgtttgcaggtgacatgatcttattagactttttcctatagagctgtttgaatgccttatattctggttattaattccttgtcagatgggtagttttcaaatattttctcccattctttgggctctttcttcactttgttgcttgtttcttttgctgtgcaggagctttctaacttcatgtgatcccatttgtacatatttgctttggttgcctgtgcttgtgggtattgctcaagaaatctttgcccagaccaatgtcctggaggttttcacaaatgttttcttgtagtagtttcatagtttgaggtcttacatttaaagctttaacccattttggtttgatttttgtatatagtgagatactggggtctacctttattcttctacatataaatacccaattttcccagcaccatttattgaagaaattgtcttttctctagtgtatattcttggcccctttgagctcactgcaggtgtgtgcatttgcttctgagtcctctattctgttccattggtctacctgccttttgggggtagtaccatgctgttttggttactatagctctgtagtataatttgaaatcaggtaatgtgattccttctgttttgttctttctgcttaggatagctttggctattatggactcttgcatttccacataaattttaaggttgtttttctatttctgtgaagaatgtcattgctattttgatagggattgcactaaatctgtagattgctttggatagtatgaacattttaacaatattgattcttccagtctatatatagttttatagttttcattgtagaggtttttcacttctttggttaagttgactggtaggtatttaatattatttgtggctattgtaaatgagattatgttttgatttctttttcaaattattcattgttggcatgtagaaaagctactggtttttgtatgttgaatttgtgtcctgcaatgttactgaatttatttaacagttctaaaagtttccctgtggcatctttaggcttttcccaaatataagaccatatcatctccaaacaaggataatttgacttcttcctttccaatttggatgtcctttatttctttctgttgtctaactactctagctggggtttccagtactatgttaaataacagaggtgaaaatgggcatcaatgtcatattccagattttagagaaaaggctttcagttttttcccattcagtacaatactagctgtaggtctgctgtatatggcttttattatgttgaggtattttccttttatgcccagttttttgaggatttttagcatgaagggatgttacattttatcaaatgccttttcagtatcagttgaaattatgatatagtttttatcctttgttttgttgataagatgtatcacattgattgatttgcatatgttgaaccatcattgtagcccagggataaatcccactgggtcatggtatatgattcttttactgcactttggtatttggcttgatagtaattttttgaggctttttgcatctatgttcatcagggatattggcctgtagttttcttttcttcttgtgtcttttctttctttcaaattcatttatttctgctctgatcttttcttttactaattttggattcagtttgctctaacttttctcattctttaagatgtatcattaggttatttatctgaaatgtttctccttttctgatgtaggcacatagctataagattctctcttagtactgcttttgctgtctcccacatgttctggtatgttgtgtttccactataatttgtttcaagaatttttaaaattgtcttcttaatttcttcattgacccactggtcattcaggagcacattgtttaactccatgtgtttatatagtttcaaaattttttcttgttattgatttctggttttattccattgcttgatataatcttaatttttttgaatgttttaagacttgtgttatgacctaacatatggtctatcattgagaatgattcatgtactaaagagaagaatgtgtattctacagccattggatgaaatgttctgtaaatatctattatgttcatttgttctatagtgcagattacgtctgatatttctttgaagtcttcaggtattattgtattgaggtctatctctctttagctctaataatgtttgcttcatatatcttgttgctccagtgttgtgtgcttatgtatttacaattgtaatatccttttgctgaattgacccctttgtcattatataataatcttctttgtctcttattttttattgtgaaatctattttgtttgatataattaaagttactccttctctttttttggtttccattggcatggaatacttttttccatccctttattttcaatctatgtgtatgtttataggtgaagtgtgtttcttgcaggcaacagacccttgggtcttttttttttttttgatggaatctcgctctgtcatcaggctggagtgcagcggtgtgatcttggctcaccgcaaccaccgcctcccggtttctgctgcctcagcctccggagtagctgggactacaggcacatgccaccacgcccagctaatttttttatttttagtagagacagggtttcaccatgttggctagtatattctcgaccccttgacctcgcgatccacctgccttggcctcccaaagtgctgggattataggcgtgaaccaccgtgcctggccaggccttgttttttttttaatctattcaacctgtctatgtcttgaattggagcatttgttccatttacattcaatgatattattgataaatatggacttacccctgcaattttatttgttttccagatcttttctagtcttctcttccttctttctttccttctttttttttattattattttactttaagtttcagggtacatgtgcacaatgtgcaggttagttatatatgtatacatgtgccatgctggtgtgctgcatccattaactcgtcacttagcattaggtatatctcttaatgctatccctcccccctccccccactccacaacagaccgagaatgtgatgttccccttcctgtgtccatgtgttctcattgtttaattcccatgtatgagtgagaatatgcagtgtttggttttctgtccttgcgatagtttactgagaatgatgatttccaacttcatccatgtccccacaaaggacatgaactcatcattttttatggcagcatagtattccattgtgtatatgtgccacattttcttaatccagtctatcattgttggacatttgggttggttccaagtctttgctattgtgaatagtgctgcaataaacatacttgtgcatgtgtctttatagcagcatgatttatagtcctttgggtatatacccagtaaggggatggctgggtcaaatgctatttgtagttctagatccctgaggaatcgccacactgacttccacaatggttgaactagtttccagtcccaccaacagtgtaaaagtgttcctatttctccacatcctctccagcacctgttgtttcctggctttttaatgattgccattctaactggtgtgagatggtatctcattgtggttttgatttgcatttctctgatggccagtgatgatgagcattttttcatgtgtcttttggctgcataaatgtcttctttcgagaagtgtctgttcatatcctttgcccactttttgatggggttgtttgtttttttcttgtaaatttgatggagttcattgtagattctggatattagccctttgtcagatgagtaggttgcaaaaattttctcccattttgtgggttgcctgttcactctgatggtagtttcttttgctgtgcagaagctctctagtttaattagatcccatttgtcaattttgacttttgttgccattgcttttggtattttagacatgaagtccttgcccatgcctatgtcctgaatggtaatgcctaggttttcttctagggtttttatggttttaggtctaacgtttaagtcttaatccatcttgaattaatttttgtataaggtgtaaggaagggatccagtttcagctttctacatatggctagccagttttcccagcaccatttattaaatagggaatcctttcctcattgcttgtttttgtcaggtttgtcaaagatcagatagttgtagatatgcggtgttatttctgagggctctgttctgtttcattaatctacatctctgttttggtacgagtaccatgctgttttggttactgtagccttgtagtatagtttgaagtcatgtagtgtgatgcatccagctttgctcttttggcttaggattgacttggcgatgtgggctcttttttggttccatatgaactttaaagtagttttttccaattctgtgaagaaagtctttggtagcttgatggggatggcattgaatctataaattaccttgggcagtatggccattttcacaatattgattcttcctacccatgagcaaggaatgttcttccatttgtttgtatcctcttttatttcattgagcagtggtttgtagttctccttgaagagatccttcacgtcccttgtaagttggattcctaggtattttattctctttgaagcaattgtgaatgggagttcactcatgatttgactctctgtttgtctgttgttggtgtataagaatgcttgtgatttttgtacattgatttgtatcctgagactttgctgaagttgcttatcagcttaaggagattttgggctgagacaatgggattttctagatatacaatcatgtcatctgcaaacagggacaatttgacttcctcttttcctaattgaatgccttttatttcctttccctgcctaattgccctggccagaacttccaacactatgttgaataggagtggtgagagagagcatccctgtcttgtgccagttttcaaagggaatgcttccagtttttgcccattcagtatgatattggctgtgggtttgtcatagatagttcttattattttgagatacgtcccatcaatacctaatttattgagagcttttagcatgaagctttgttgaattttgtcaaaggccttttctgcatctatcgagataatcatgtggtttttgtctttggttctgtttatatgctggattatatttattgatttgtgtatattgaaccagccttgcatcccagggatgaaacccacttgatcatggtggataagctttttgatgtgctgctgaattctgtttgccagtattttactggggatttttgcagcaatgttcatcaaggatattggtctaaaattctcttttttcattgtgtctctgcccggctttggtatcagggtgatgctggcctcataaaatgagttagggaggattccctctttttctattgattggaatagtttcagaaggaatggtaccagttcctccttgtacctctggtagaattcggctgtgaatccatctggtcctggactctttttgtttggtaagctattaattattgccacaatttcagatcctgttactggtctattcagagattcaacttctttctggtttagtcttgggagagtgtatgtgtcgaggaatttctccatttcttcgagattttctagtttatttgcatagaggtgtttgtagtattctctgagggtagtttgtatttctgtgggatcagtggtgatatccccttcatcattttttattgtgtctatttgattcttctctcttttcttctttattagtcttgctagcggtctatgaattttgttgatcctttcaaaaaaccagctcctggattcattaattttttgaagggttttttttgtctctatttccttcagttctgctgtgattttagttatttcttgccttctactagcttttgaatgtgtttgctcttgcttttctagttcctttaattgtgatgttaggttgtcaattttggatctttcctgctttctcttgtgggcatttagtgctataaatttccctctacacactgctttgaatgtgtcccagagattctggtatcttatgtctttgttctcattggtttcaaagaacatctttatttctgccttcatttcgttatgtacccagtagtcattcaggagcaggttgttcagtttccatgtagttgagcagttttgagtgagtttcttaatcctgagttgtagtttgattgtactgtggtctgagagacagtttgttataatttctgttcttttacatttgctgaggagagctttacttccaactatgtggtcaatgttggaataggtgtggtgtggtgctgaaaaaaatgtatattctgttgatttggggtggagagttctgtagatgtctattaggtccgcttgatgcagagctgagttcaattcctggatatccttgttaactttctgtctcgttgatctgtctaatgttgacaatggggtgttaaagtctcccattattattgtgtgggagtctaagtctctttgtatgtcactcaggacttgctttatgaatctgggtgctcctgtattgggtgcatatatatttaggatagttagctcttcttgttgaattgatccctttaccattatgtaatggccttctttgtctcttttgacctttgttggttgaaagtctgttttatcagagactaggattgcaacccctgcctttttttgttttccatttgctcggtagatcttcctccatccttttattttgagcctctgtgtgtctctgcacgtgagatgggtttcctgaatacagcacactgatgggtcttgactctttatccaatttgccagtctgtgtcttttaattgtagcatttagtccattgacatttaaagttaatattgttatgtttgaatttgatcctgtcattacgatgttagctcgttattttgctcgttagttgatgcagtttcttcctagtctcgatggtctttacattttggcatgattttgcagcggctggtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgagaattcttttctttaagagtgttgaatattggcccccactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttctcgaggagtatgtttgtggcgttctctgtatttcctgaatctgaatgttggcctgccttgctagattgaggaagttctcctggataatatactgcagagtgttttccaacttggttccattctccctgtcactttcgggtacaccaatcagacgtatatttggtcttttcacatagtcccatatttcttggaggctttgttcatttctttttattcttttttctctaaacttcccttctcacttcatttcattcatttcatcttccatcactgataccttttctttcagttgattgcatcggctcctgaggcttctgcattcttcacatagttctcgagccttggctttcagctccatcagctcctttaagcacttctctgtattggttattccagttatacattcgtctaaatttttttcaaggttttcaacttctttgccattggtttgaatttcctcctgtagctcggagtagtttcatcgtctgaagccttcttctctcaactcgtcaaagtcattctccatccagctttgttccgttgctggtgaggaactgcattcctttggaggaggagaggcactctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactctagaccctgtttgcctgggtatcagcagcggtgtctgcagaaccgcggattttcgtgatccgtgaatgctgccttctgatcatttctctggaagttttgtctcagaggagtacctggtggtgtgaggtgtcagtctgcccctactgggtggtgcctcccagttaggctgctcgggggtcaggggtcagggacccacttgaggaggcagtctgcccattctcatatctccagctgcgtgctgggagaaccactgctcttctcaaagctgtcagacagggacatttaagtctgcagaggttactgctgtctttttgtttgtctgtggcctgcccccagaggtggagtctacagagtcaggcaggcctccttgagctgtggtgggctccacccagttcgagcttcctggcagttttgtttacctaagcgagcctgggcaatggcgggtgcccctcccccagcctcgctgccaccttgcagtttgatctcagactgctgtgctaccaatcagcaagactccatggtcgtaggaccctctgagccagatgcgggcgggatataatgtcctggtgagccatttcctaagccagtcagaaaagcgcagtattcgggtggggagtggcccgattttccaggtgccgtctgtcacccctttccttgaccaggaaagggaactccgtgatcccttgtgcttccctagtgaggcaatgcctggccctgctttggctggtgcacggtgcactgcacccactgtcctgcacccactgtctggcactccctagtgagatgaacctggtacctcagatggaaatgcagaaatcacccgtcttctgcgttgctcacgctgggagctgtagaccggagctgttcctattcggccatcttggctcctccctttctttccttcttgtctttcttttagtaaaggagattttctctggtggtatgatttaatttcttgctttttgttttttgtgtattcattgtatgtttttcaatttgaggttaccatgaggctttcaaatactatcttataacccactattttaaacagatgacaacttaaaactgattgcataaatgtgcaaaaagaaaactaataaaaactctacactttaaattcatccccccactttttaactttttgttgtttctctttatgtcttattgtactgtctatgtcttgaaaagttgcattttttattggctcattatttagtctttctacttaaaataagagcagtttatactctaaaattacagtgttataatatcttttgcttttctttgtgcttgctattaccagtgagttttgtaccttcatatgatttcttcttgctcattaacatcgttttctttctgattgaagaacaccttttagcaattcttgtacaagtctggttttatgaaatatctcagcttttgtttttctgggaaagtctttattgctccttcattcttggaggatatattcaccagatagactattccttcaatactctaaatatgtcatgctacactctcctgacctgtttgatttccactgagtagtctgctgccagatgtattggaacaccattgtatgttatttatttattttctcttgcttgttttacaatcatctcttcatccttgacctttgggaatttgagtattaaatgcctttaggcagtcttctttgggttaaatctgcttggtgcttaaaaccttcttatacttcaatgttgataacttactctaggtttcggtagttctctgattttttttttgaataaacttgctacccttatctctttctctgcttcatctttaaggggattaactcctagatttgcccctttgaggttattttctagagcttgtaggtatgcttcattttatttttgaattttttctcctttgacagtgtattttcaaataacctgtcttcaagctcactaattatttcttctgcttaataaattctgctattaagagactctgatgcattctttagtatatcaattgcatttttcaactctagaatttcttcttggttctttataattattttagtttctttgttgaatttatttgatagaattctgaattccttttctgtattatcttgaatttctttgagggcctcaagacagccattttgaattctcatctgaaaggccacatatctgtttctccaggtttggtcactggtgtcctgtttaattgatttgatgaggtcatgttttctggaagatcttgatgcttgtagatattcatcagtgtctggacattgaagagttaagtacttattttagtcttcacagtctgggcttgtttgctcctgtcgttattaagaaggctttccaggtattccaagggacttgggccctaagcccaataacactggtttttgcagacttgtataagtactgtgttggcggtcttagataagatccaaaagaattttctggattaccagtcagaggctcttgttctttttccttagtttctcccaaacaaatagtctctctctctttctctctctctctttttctgccaagccacatggagtgtgatggtgcaaggaccactgtggctacactactgggatttcactgagtcagacctgaagccaacacagcactgggtcttgcccaaggccctcagtaaccattacctggctaccgtctatgttcactcaaggccctagggctctatgaccagtagttggcaaattcacccaggtttgtgtccttcccttcagggcagtgaattcccccaggccccaggtgggtccagagatgctgtctgggagccagggatttgaggaaaaaaaacttagaaatttgcctgatgctctgtgctactgcagctaagctggcactcaaaccacaagatgcagtccttccctccctttccatagtcagaggaacatttccctgtggccaccaccaacactgccctataggggtttctgccaggccactgccagtgttcacttaaggcccaagttctcttcagtcagcttgtggtgaatgatgccaggccctaaactcacccttcagggcaatgatctcttctctggcccagagaaggcccagaaatgctgtccaagattctaggcctgaactcagggaccccaagagcatgcttgttgctctacccaattgtagtcaagctgatacttaaggtgcaagacaaaatctccttaacttttcactctacttttctcaaacagaaggagtctttatccatacaccacagctggcaatgtgctcagtgatacctgaagccagcaggtctcacagcccaaggcccatggcatactacctgggtattgctgctggttattcagggcccaagggctctttagtaagcaggtgatgaattctgccaagaccgtttcttcccttcaaggcagcgtgttcccttttgacccagggtatatctagaaatgctgtctgggagctagggcctggaacaggaacctcatgactgactctgcctgagctgaggaagtagtcacttttgctgctgtgagtttcactgcctgggttggggaaggggtcgtgcaagcattcctttacctgcccagcttgtctccctatgtcatgtgccaccctagtcctctggctctgggcccagcccagcagtaagagttgtctaggaattgcagttcttgtgtgctagactgcctttcaagtttatcaaggaccccagagcactgtgacccacagtagcaaggcttgccaagaaattcaagttccaactgctggagtgggaagttctcctctggctgagtctggtccaaatgctctctctctgcatgaatgctggctgaacccagcacagtttgctctcctctctgctgtgatagagcattaccgagttcgatgttaagtcttccagttactgcactctccctcccccaagtgcacagagtctccatgcagcatggctctactgggggatggaggagatgtggcattggcgactcaagactgtctctttgactctcttcaatgcctctttcaaagatatgaagttaaaaacatgtactatgattgctcacctgatttttggttctgcggtggtgcttttctgtgtgcagacagttgttaaaatttggtgttcctgcatgtgagacaaatggtgtaggctcctattctgccatcttgctccaacccatcctattctatatttttatttttatttgccatatataatgaggagtgaaactgcatttaactctgtcaagtttctctgcaatttagtacctatgtaaatcacaatagcatttaccaaatattccattttctgctcttgatttctcacacaaccacttggtgaggcagagtcatatgacttgttctggctagatactcagagtataaaaccttctgaagtggagggaaaaagaaagtagcaaccatagcaaagttagagtagttataccattatcaatcaagagagactttaaaccaaaaagtatgttactagagacacaaagggacattttataatgataaaagagtcaatgcattagaaagttataacaattatatatgcatctaataacagagcaccaagatacatgcagtaaaaactgacaggaatgaaggtaaaaatatataaatcaaaaatagttgttgaagatgtcaatatcccattttcaataatgatacaatgaccacacataagattagcaagagattaggtttgaacaacactataaagccatgagtcctaagagacatcaatagagccttccattcaacgacaatagaatatacattcttctcaagtgcatatggaacattctccaggatagagcaaatgctagtccatagacaaaacttcagtaaatttaaaatgagagaaataatatgaagtatgttctctgaccacaaaatatttaatttgaaatcaataataagaatttgggaaactcacatatatgtgaaaattaagcaagatactcccaaataaccaatgggtcaaagaacaaatgaaaggggaaattagataatctcttgaaatgaataacatgacgacatagaataacaaaatttatgcaatgcaacaaactcggtgcttagagggtaatttatagctgtaaatacctatgttaagaaagaagaaagactacaaatctataacctaaccttccaacttaagacacaaaaagaaaaacaacccaaaccttaaacaagcagaggaaatagtaaagattagaatgggaattaatgaaatagataataggaaacctatcaagaaaatcaaagaaacaaaaagctatttttttaaaagctcaacaaaattgaaaaacttttatctaggttgaccaagtaaaaagggagtggagacacaaattaccagaatcagaaattaaagagagatgattactactgaccttacagaaataagaaggggtataaagaaatactatgaataattgtacaccaacaaattagattacttagatgaaatggacaaattcctggaaacacaaactgctgaaactgattcaagtatgagtcttcataggcccataaccagtgaagagcttgaatcaataatttaaaaccacccataaagaaaagacgagacccacattgctttatcactaaagtctatcaatcattttttgaaatactaattcttcctgaactcttccaaaaaacagaagaaggaatgcttctcatctcattttataaatttatagctttttataccctgacaccgaaaccaaatacaccacaagaaaaaaaaaacctacagatcaaaatctcttatgaatatggatacagacattttcaacaaaatactagcaaactgaatatggcagcacataaaaagagctatacaccatgaccaagtggtatttatcccaggaatgcaagattggtttaatattttaaaaaatcacttaatataatacatcatattaataaaacaaaactaaaaaatacatgactatctccataaatgcaaaaaaaggatttgacaaaatccaacattctttcatgacaaaaacactaaaaaactgggagtaggtggggacttcctcaacatgataatgaacatctatgaaaaatcaacagcttatgtcatacttctgttcaaagactgaaggcttccccctgagatcaggaacatgacaaggatgtctgctctcaccgtttttactcaggattttactggaggttataaccagtgcaattagtccagcaaaataaataaaatgtatccagattacaaaggaagggttaaaactatctctatttgaagatggcatcatcttgtatacagaaaatcttaaggaatccataaaaaacgatagaactaatcaatgaagaatcagaaagaaaagttggaaaagcaatcttatttacaatagcatccaaaagaataaaatatttagaaataactttaaccatggaggtaaaatatctgtacagtgaaaactataggacattgatgaaagaaattgaagacacacgtaagtagaaagatatcctgagttattgaaacagaagaattaacattgttacaatgtccatactactcaaagcaatccgatgaaaataaatgaaaatcctatcaaaattctaatcttatttttcacagaaaataaaaaatcctaaatttgcatgaaaccacgaaagaccctgatttcaaagcaatcttaagaaagactaacaaatttagaggcatcacacttcctatttcaagctgtattgcaaagctgtagaaagcaaaacagcatggtactggcataaaagcagacacatagagcaatagaatagagagcccagaaatatactcatccatctacagtcaatttatctttgacaaaggtgtcaaaaccatgtcatggggaaaggctcttcaataaattgtattgggaaaactggatatccacaggcaaaaaaaaaaaaaaaaaaaaggacccttattttacactacttacaaaaatgaactcaaaatgaattaaagacatacatgtaacacttgaaaccttaaactcctaccaaaaaaaacaggaaaaagatctccttgacattgttctcaacaataattttttgcacatgacaccaaaagcaaaaataaacaagtggggttacatcaaactaaaaagcttttgcacaacaatgaaaacaatcaataaaatgaaaatgtaactgacagaatgggagaaaatatttgtaaaccatatacctgataaagggttgatatttgaaatttataaggaagtcctacaactccttagcaaaaacaaaacaagaaaaacaaaacccagaaaacaacaaaaaacccactcctaataatcctattaaaaatgggcaaagaagctgaatagacatttttgcaaagaagatatacaaatggccaacagatataatgaaaagttgctcaacattactaatcatcaaagaaaacaaaaccacaatgaaatatcacctcacatctgttaggatagctattataaaaaagacaagagataacaaatgttgactaggatatagagaaaagtgaacccttgcacaggttgatgggaatgtaaattggtgtacattaaggaaaacagtatggagaattcttgaaaaattaaaaacagaactaccatatgataaaacaatctcacttctcattatatatccaaaagaattgaaatcaagatcttgaagagatagctgcactcccaaattcattgtagcattattcagaagagccaagatatgaaaacaacttgtatgtctattgacagatgaatggataagaaaaaaaactgtggcatatacaaacaatggaatattattcagtctttaaaaagaaggtaatcctgccatatgtgactatgtgaattaatctagagaacattatgctaagtaaaataagctagtcacaaaagacaaatactcaatgattccactaacagaaggtatctaaaatagtcaaactcatagaagcagagagtaaaatggtggttgtaggggctggggcaaggaagaaatggggaatatgttaaatgtgtataaagtttcagttatgcaggatgagtaacttctagagatctgctatacaagttggtgtctatagtcaacaatactgtattgtgcactttaaaaaattgctgagggtagacctcataatgagcattcttactacaataaaaggagagtcctgaggaaacttttagagatgatggatatatgttaattactttaattgtagtgatggatttattgtgtatgcctatgtccaaacttaccaaattgcttgcattatatatatgcaggtgtgtgtgtgtgtgtgtgtgtgtgtgtgtgtgtgtgaaatcttaccatcaagccagtaatcaagaaggtgtggtattggtataaacacaggcatattgaacaatggaacagaataacaacccttaataagtgaaataattccagtcagtaaaaacacaattctaaaagataaaaatataacccagaaattttactcctgagtatcttccaaatagatacagaaatattcattcgtgcaaagatttttacatgaatgtttatagcagaaatcctaacaatggttaaaaagtgaaagcaacacaaatgtccatcaattgctgaatggacaaaccacattcctcaaaatctgaatttgtcagtctagattaacctctgttactcagtctggatctcatggacctcaaacctcatttcttcaccctctggatatctcagccttgccaatccctcattctcaattttgtcatccactgggatgtaggttatcagcatttaagggtatgaaacttgaggctgacgagtcacaatttttaaaaagccagtatctccagttgatctaatctttatctcccactctttaaaaattttaactcctacacataaccaccatttctcttccatcttcaaattctcctactctagtggttacttccatcaatgtacaatttatgctctactgtcctccattttcaacaaataccttcccttgatgacacttccctaccagctattgttctatatatctgctgtcctgtttatatgctggattacatttattgatttgcatatgttgaaccagccttgcatcccagggatgaagcccacttgatcatggtggataagattttgatgtgctgctggattcggtttgccagtattttattgaggatttttgcatcgatgttcatcagggatattggtctaaaattctcttttttggttgtttctctgccaggctttggtatcaggatgatgctggcctcataaaatgagttagggaggattccctctttttctattgattggaatagtttcagaaggaacggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaggacgtatgtgtcgaggaatttatccatttcttctagattttctagtttatttgtgtagagttgtttatagtagtctctgatggtagtttgtatttagaatgccgatcattaaaacgtcaggaaacaacaggtgctggagaggatgtggagaaataggagcacttttacactgttggtgggactgttaatgcccctagggaggcattaacatcattgattgagatataatctcttgaacaatataagaggcatagtaggcgcacaacgaatggttctgggtcaacaaaaaactgacagcctcacaaatctacattcatgttgcttagggttgccagtctgggaccaagaggaattatggcatttgaagagaaataatgtgtatcgattattttaaagcatcctctgtttcaagaggcaaagcttgaatgtgcaatggggtgataacttcggttttctcaatctagcttgaactgtattatagaaaagatactaataataataggcactgtttattgagttactaagagccataaaaaggcctactttgttagagtgccagcaacattttccagatgcttcaggtggaatccgtttcttactcttgtgtcagctgaaatttgagcttgaaagagacactctattatgagggaatccacttttacaagccattttcattatgcagccatcaaaatagacatatctatgtattattttgagaaaatccatgcactggggcatgatttatatgcagatgcttcaaattaaggtagtaaatactaagctgaataatataaaaagctgtattgataatataaggtatatcttggcagagatcaagacgttacctcctttttggctgggccagagagaatgggagttagttttctagtcttagagaatgtggggcagagtcaagtgggatcacagtctgacgaagtaattagattcctgcaatattgtggtaggtcagtgcataagtagtggacattccatgatatggaaaaccatagtgtcacccttttgtgcactgtaatatcctctagtttcctaaaatgggtagcatgtttgttaaacgttatagtctgctgttagcagtgttttgggaatgaaggaacaggtagatctgggaaaggaaagagcagtagcctgcggaattggatggagaccctgacagttccccgctagagaaggctggaactgccaactaagccggaggtgacaagtaacaacccccatggatttctggaacatgtaagcactgcccggggaatttaatatatattaagagagagttcctgtagtcagccaggtaaccgtctcagaaggaacttacttggtattgttggaagagacagacagggagagagagagagagagagagagagaggcttttctccacctctgcctctccgtttttcagcccacagagaagatcaaacagaacttgaaatgggtatgtgtttacatatgagagctgaaaaaagacagtagaatattctcttgctcagtctcagctgggaacatgtgtgtcaggtgactcaatgtttttgctggtctgtgcatgtctgcaaatgaccacaaacatgctacaagtattgatttgggggttacaaataaattttagcaagtatacaaattccagtgtacaccagaattcaacaaggcgatgatgaagaacttcggaggcacagaaactcgagatagcagcatagagagggaagtgaagcccctggcctaaataggctttggagtcaagaggcactccccattgtgggaaaaaggtaagcagaaaatccctagcagtgctcattctcaccatggatgcctgcaatcctagctacaggagatcctgacagccctcacaggtcctgagtccagtatagggagctgcctagagttcatgtgactgcattcttttagagagggaattcacactacattttcccgtgaccccaggactcacggggactcagactgctgcagtatggtgccattttgagagcagagtcacgggagtatgtattgcccttgatgttcaatggcccctgtatctccacatccctggagccctgtcaatatcccaccacaaccacctacagggctgcacagtggggtgttgaagtcctcaactattatttattggggtctggttatccctttagctttaataatatttgctttatatatctgggtgctctggtgttgtgtgcacacatatatttacaattgtgatattcttttgttggatgtttttttactgtataatgtccttctttgtctctttttatagcttttgatttgaagtctgttttgtctgacataagcataattactcctgctcacttttggtttccatttgcaaggaatatctttttccatcccttcactttcagtatacgtgtgtgttttcacagatgaggtgagtttcttgtaggcagtatatagttgggtctttaaaaaaatcattcagccaatctatatcttttaaacagggaatgcaatccatttacattcaaagttgttattgattaggtgaggacttactcctttcattttattgattttctagttgttttgtatgtactttgttccttacttcttctcttattgtttatttttgcagttgggtggctttctgtagagataaggtttgacttttttctttttctcctttgtgtgttggctctaccagtgagttttgtagtttcacatgttttcatgatcatcttttcacttccagatgtaaaactcctttgagcatttcctgtaagtctggtctagtggcaattaattcccttattttttgcttgtttgtgaaatgttttacttctgaaggatatatttgctgggaaatattttatgggtaaaacttcaaaagcacaggcaaaaaagcaaaaatagacaacttggttatatcaaactaaaaagcttctttacagtaaagaaaacaatgaacagggtgaagagcaggcaaatatatttgcaaactattcatctgacaagagattaatatccagactatacaatgaactcaaaaacctcaacaggaaaaaaacagattatctaataaatgtgggcaaatgatatgaacagagatttctaaaaaaaaaaaaacatgcaaatggccaataagtgcacgtaaaaatgctcaacatcactaatcatcagggaaatgcaaatcaaaaccataatgagctattatctcactccagttaaaatggctaatatcaaaagaaaaaaaataacaaatgctggtgaggatgtgaggaaaaaggaactcctatactgttgatgggagtgtaaattgctgtaacttttatggaatacagtatggcagttcctcaaaaagttaaaaatagaactaccatatgatccagcaattctactactgggcatttatccagaggaaaggaaagagatgtctgaatccccatgcttattgcagtactattcacaatagtcaagatatggaatcaacctaagtgtctgtcaacacatgaatggataacgagaacgtggtatatatacacaatggaatactattcagtcataaaaaagtaaatcctatcattcattgcaatatggttaagcctagaggacattatgctaagtgaaatatcgggcatagctgggcacagtggctcacacctgtaatcccagcactttgggaggccagtgtgggtggatcacttgagcccaggagttcaagaccagcctgggcaacataatgagaccctgtctctacaaaaaattaagaaattagctaggtgtagtggctcatgtctgtagtcccagctacttagagggctgaggtgggatgattgcttgagcctgggaggtcaaggctgcagtgagccatgatcatgccactgcactacagcctaggcaacaaagcaagcacctgtctcaataaataaataaataaataaataaataaatgaaaaagaaatatcaagcacaggtacataaatattgcatgtttttactcatgtgggagctaaaaaagttgagctcataaaagtattagaagagtaggattgtggttgttagaggttaggaagggtagggaggaggaaaggatagggagaggttgatcgatggatacaaaatttcagctagataggaggaacacattctagtattctatagaactatagagtcactgtagttaagaataattttgtaacttaaaaaattagtacaacttgggaatattttgcttcacatagactggattatttaattaaaatttatttgtttattgattctgttacacctaaaattatgtatggagaatatgtgtgaaaagggatactagaatttgagtaaaaacacaagggtttatagtaaaagataatcttttatataactcttgggaccatcttgaactctattgaagtgttacgtccttcaatcattctaaatttcataaagattgtcagtttttctgccaggtggggtggctcagcctgtaatcccagcatttggggaggctgaagtgggaggattgcttgaacccagggtttcagaccagcctgggcaacatggcaagacctcgtctctacaaaaaattaaagaaaaaattagctgggtatggtggcatgtgcctgtggtccaagctacttgggaggctgcggtgagagggtggcttaaacacaggaggttgaggctgcagtgagcaatgtttgtgccactgcacttcagcctgggtaacagagtgagaccccatctcaaaaaaaaataatgtcggtttttctaggtctgctatatttatgtaatatgcattgcatttttcttttattttttaattatacaaataatacatgccgattgatttttaaaaggtctttcagtctatatgacacacaggtataatctttcaccatcatactctcctcttcaaaggagctactttaccattttactatgtaagttcttctaaaaacttctatgcatttttgagcaagaatctactatattatttataagcaataaaaaattcatccattacattttgaggcctcagcataattttcaattgctcagaaattcaaaaactcaaaaacattttgatgttactttattttacttacatcttacttacttttctgtaaatagatacaatcttttaaaaatgtggtcaattcccaaacttttatgttattcctcaaaagcaccaaccttctcaagacaacgaatattacatactgtactgaacagcctttcaatttcagcaagtagaacacaaaatggtgggcctgcatgtttagttggatcataagaaagaacacacatgaggtactgaaaccctttacccaggttggacgacattataactgcatagcatttgtgatcagctggattaatggcaactaatgctcttccatcctaaatcctgtcaaatttgccaatatttgctctaggaggataaaaaatacagcaacagtacaatgaaatgttccccaaagaactcttaaacactttggctccaggaattttggtgattggctcttctgagtaagaaagattctgctctgtaaaaaaatctcatatcccacaccaagtacttggtgatttccacagcaagtacttggtgatttccacaccaaaagtacttggtaatttccacatcaagtacactgtgtccccagtctgcaaaatatttcatctcaactgcttttccacacagaggaaaaaataccctcactccactcttgcctttaagaaaagtatctaaatgctgctttaatagctgatgtccttgtttttgacgaaaaccaatatttcagttcacccacttgtcttgccattcttgcagagttagtacttgttttttttgcacctcagtatctgggtactattcaatatcaagtgaagttcttgtaccatccatagttttgtagacacttttgtctcacaatcacatatcttcaatgcctttatgggtttattataaaggatattgcaaaggataaagatgaagagatgtgtagagtgaggtaggcatgccatgctccaggaacctctaaatgttcagctaccaggaagctctctgatatgtttaggctatgtctccatccaaatctcatcttgaattgtagttcccataatcctcatatgtggtgagagagacccagtgggaggtaattgaatcatggtgatggttacccccatccagttcttgtgatagtgaatgagttttcacaagatctgatggttttataaggggcttttcaccctttgctcggcacttctctctccttccaccctgtgaagaaggatgtgttttcaaaatgattgtaagtttcctgaggcctccccagccatgcagaactgtaagtcaattaaacctcttttctttataaattacccagtcttgggtatttcctcatagcagtgtgagaacaaactaatacactctccaataataatttacagtatatttttaaacagttagaaacaaggattttgaatgttcccaacacaaagaaattgtaaatgtttgaggtgatatacattctaattaccccaatttggtcattacatattgtatacatttattgaaatatcacttcctactccataaatatgtatgattattatgtgtcaattaaaagaaaatttccaaaaaattgtttgactatgtatgcaggggattatttctggactgtctattctattccattggtctatgtgtctgtctttatgccagtaccaacactattgattactgtagctttgaagtaacttttgaaattgagaattgtgattcctccaacttcgttcttccttttcaagattatattggtgatttagaatcccttgaaattttttatacattttatggttctactactccatttctacacaaaaggccactggaatttgataaggattaaactaaatctgtacatcactttagatagcattgatattttgagaataatgtctttcaagacacgaaaatatattttttcaattttttaaaggttttctttaatgtctttcagcaatgttctatagttttcagtgtgcaagtctttcacatccttgggtaaatttattcccaggtattctttgtatgttattgcaaatgtcatagatttctttattttttgtttagttcattgctggtatgtagaaacaactgaattttagactatcatataattttgctgaattcatttattaactctagtagctttttttgtggattatatgtgattgtctacatataggattatcgcacctgcaaatagagataggtttactttttcctattttgaatgccttttatttcatttttttgcctaattgccccagttagaactttcagtacaatgttgaatatcagtgataaaagcttgtcttgttcctgatctgggggaaagcttttagtgttttgaaactgagcatggtgatagctatagttttttaaataaatgccttttaacatgttgaagaagttaccttttacacttaggattttttttctgtttttatcatgaaagggtgttggatcttgtcacatgtcttttaaacatcaatttggttggttatagtttttcttttcttcattctattaacgtggtttattgcattgattgatagtaatatgttgaaacacccttacattctttgaataaatttacttgttcatggtttataatcctttcaatatgctgttggattcagtttgtatgcattaagtatttttgcacttgtattcataggggatattggtgtgtagttttcttgtgaagactttatctggtttttgtatcagaataatgctgacctcataaaatgaattaggaagtgtccttttactactttttttggaagagcttgagtagaactctcatttcttcttatttaaatatttggcaaaattcatagtgaagccatctgttcctggtctcctctttgtggagaggtctttaaaattactgattcaatctctttacttgatatacattttcagattttctatttctttttaagacagttgtggtaatttgtgttttgtaggaagttggccattatatatagtttatctcattccttggaatacagttcttaatagaattctatttcttatttcattaaggtcagtagtaatagccctgctttcacttataatttagttgtttacctgttctctctttttaaattcaggttagctaaagttttgtcagtttagttggtatttgcaaggaaataaattgagttttgttgcttctcctattggtttcctatttcacagattgccactctgatctattatttccttccttctactagatttggcttttgtttgctcttgtttctccagtttctaaaggtttaaagttagtttactgattagagatttgtgtttttttaaaaaagtatttaattgacaaagattgtaaatattgtaggtgtgccatgggatgatctgatttatatgttatataatggttaccaccatcaaataaattaagacctatcaccacctatgctgtactttaggtctacagacttgttcatcttataacttaaagtttgtttcctttgaccaatatcttcccatttcctccacgcccctctcctagaaccaccattctactctccaatgctgtgagtttgacttttttagattctctacataagagagatcatacagtatttgtctttctgtgtctcattttttttcacttagcataatgtcctccagactcatctatgttattgaaaatagtatattttttatagctgagtaatatttcattgtatatatatcacattttcttttttttaacttttattttaagttctagggtacatgtgaaggtttgttgcataggtaaacttgtgtcatgggagtttattttacagattatttcatcatccaggtattaagccgagtacccaataattatcttttctgcttctctccctccactctcaagtacacctcagtgtctgttgttttcttctttgtgttcatcagttctcataatttatttagctcccacttataagtaagaacatgtggtattttgttttctgctccggggttagttttctaaggataagagcctccagctccgtccatgttcccacaaaagacattatcttgctctttttaatggctgcatagtattccatggtgtgtacgtaccacatattctttatccactctgtcactgatgggcatttatattgattccatgtctttgctattgtgaatagtgctgcaatgaacatttgcatgcatatatttttatggtagaatgatctgtattgttttgggtgtatacccggtaatgtcattgcggggttgaatggtagttctgcttttaactctttaaggaattaccatactgcttttcaaaatggttgaactaatttacactcccaccaacagtgtataagtgttcccttttctctgcaccctcagcagcatctgcctttttttttttttactttttaataatggtcattctgactggcatgagatggtatctcattttggttttggcttgcatttctctaatgatcagtgacattgagctttttctcaaatgcttgttggcctcatgtatgtcttctcttcataagtgtctgttcatgttctttgcccactttaaatggggtcgtttgtttttctcttgtaaatttgtttaagttccttatagatgctggatattagacctttgtcagatgcatagtttgcacattttttctcccattctgtaggttgtcagtttattctgttgacagtttgttttgctgtgcagaagctcttcagtttaagtagattccatttgtcaatttttgcttttattacgattgcttttggtgtcttcatcatgaaatcttcaccctttcctatgtccaggatggtattgcctaggttgtcctccagggtttttatagttttgggttttatatttaagtccttaatgcatcttgagattatttttatatgtgatgtaaggaagggttccagcttcaatcttgtttatatggctagccagttatcccagcaccatttattgaatagggagtcttttccccattgcttgtttttgtcagctttattgaagatcaaatgattgtaggtgtatggccttaattctgggctatctattctgttccattggtctatatgcctgtttttgtaacagtaccatgctgttttatactgtagccctgcagtatagtttgcagttgggttacatgatgcctccagctttgttctttttgtttagaactgccttggctatttggactcctttttggttccatatgagttttaaaatagttttttttctagttctgtgaagaatgtcattggtagtttggtaggaatagcattgaatctttaaattgctttgggcagtatggccattttaatgatattgattcttcctatctatgagcatgggatgttttcccatttgtttgtgtcttctctcatttctttgagcagggttttataattctcattgtagagttctttcacctccatggttagatgtattcttaggtattttattctttttgtggcaactgtgaatgggattgcctttatgatttggctctcggctttgctgttgctggtgtataggaatggtagtaatttttgtacagtgattttatatcctgcaactttgctgaagttgtttatcagctgaaggagcttttgggtctagattatggggttttctaggtatagaatcatgtcgtctgcagagatagcttgacttcttgtctttctatttggatgtcctttatttctttctcttgcctgattgctctggctatgacttctaatactatgttgaataggagtggtgagagagaacatccttgtcttgtgccagttttcaacaggaatgctcccagcttttacccattcagtataatgttgaccgtgggtttgcaatagatggctcttattattttgaggcatgttcctttaatatgtaatttattgagagtttttatcatgaaggggtgctgaattttatcaaaaaccttttctgcatctattgagataatcatgtatatcgcgttttctttatccatttatccattgatggacatttaggttgctttaatattgtgactattgtgaataatgcggcaatgaacatggaggtgcagacacctctttgaaacagtgatttcatttcctttggatatatgcccaaaagaaatgcttagctagactaaccaagaagaaagaaagatctcaatcaaattaataaaattataagtgaaagaacagactttacaattgataccagagaaatacaaaggatcataagagactgctataaacaattatacaacaacatattgaataactcagaagaaatggataaattcctagatacttacaacctaccaaaactgaatcatgaaaaattagaacatctgagcagagcaataataataaagtgattgattcactaaccaaactctccgaacaaagaaaagcataggaccacatggctttactggtaaatttgaccaataatttaaaggaggtccgggagtggtggctcacgcctgtaatcccagcactttgggagatgggtggatcacgaggttaggagatcgagaccatcctggctaacacggtgaaaccccatctctactacatgcaaaaaattagccaggcatggtggcaggagcctgtagtcccagctactcaggaggctgaggcaggagaatggcatgaacccgggaggcagagcttgcagtgggccaagatcacaccactgcactccagcctgggcaacagagcatcactccatctcaaataataataataataataataataataataataataataataacttaaaggagaattaatgccaagctttctcaaactccttcaaaaaatcgtagaggagggaaaacttccaaactcattttataaggccagcattaccctgacaacaaagcaagataagaacaaaacaagaagagaaaattacaggccaatatccctagtgaagatagatggaaaaatcctgaacaaaatacaaggaaactgaatttgacagcacattaaaaggatcatacactgtgatcaagttagatttttctctgagatacatgatggtatctcacatcaataaatgtgatacacaacatcaacagaataaaagataaaatcatataatcatgacaatagagaaaaagcatttgacaaaattcaatatctttttctgataataaattatgtgtagaaggaatgtacctcaacataataagggccatatatgacaatcccacaactgacatcatacttggtaatggaaaggtggaagcatttcctctaagatcaaaacaagacgaggatgtccactctcacaaattccattcaacatagtacgggaagccctagccagataaattgggcaataaaaagaaataaaaagacatctattggaaaggaagaagttgaattgtttttatctttttattttagacttttacagcaatagatttcctcctgagcactgcttccactgcatcccataaattttggaatgttatctttcatggtcatttatctctaggtattttcaaatttccttcgtgatttgttttccgatctggtggttaagactgtgtggcttaacttctacatatttgtgaattttcttttttgtctactgttatgatttttagcttcattccattttgaacatgttaggtctagttggtttatagtggtgttcaagtgctctgttttcttatctcctgtctagatgttctatgaagtattgaaagtggagtcttgaaatctccagctattattgtagaatggtctatttcacccatagatttgatctgtcaatatttggttcacatatttgggggctcctttgttttgtgtatatatatttataatggttatatcttcttaatatattaatatttttatcaatatgtaatgcccatcattttctcttatagtaaatgtaaacttggaatctatttggtctgatattagcatagttatccttttctcctttgatgactatttgcataggatcttttctttttttgagacatggccttgctatattgcccagggtggacataaactcctggctcaagcaatccttccacctcagcctcctgagtacctaggactacaggcgcctgccactgtactcagtagaatatatttttcttttcttttcttttttgacttatgttagtggttagcttttatttcattttatttttttcttcaacttttattttaagttcaggggtacatgtacagaatgtggaggtttttagcatgggtaaacgtgcgccatgttcgtttgctgcacacatcatcccatcacctaggtattaagcccaggatccattaactattcttacagatgctctcccttccccgacctcactcaacaggccccagtgtgtgttgttccccaccatgtgtccatgtgttctcattattcagctcccacttaaaagtgagaacatgtggtgtttggttttctgttcctgcattagtttgctgaggttaatggcttccaattccattcatgtccctgcaaaagacattatctctttcctttttatggctgcatagtattccatggtgtatgcgtaccatattttctttacctagtctatcactgatgggcatttaggttgatttcatgtctttgctattgtatatagtgctgcagtgaacatacacatgcatgtatctttataatagaatgatttacattcctttgggtatatatctagtaatggaattgctgggccaaatggtatttctgcctccaggtctttcaagaattgccactctgtcttccacaatggttgaaataatttaccctcccaccaacagtataaaagtgttcctttttctctgcaacctcgccagcatctgtttttttctttaaatttcaataggtttttgggggaacaggtggtgtttggtttcatgaataagttcttcagtggtgattactgagattttggtgcacccatcacgtaagcagtgtacactatacccaatgtgtagtcttttatccctcaccacccctaccctttcccccaagtccccaaagtccagtgtatcattcttaggcctttgtgtactcatagcttagctctcccatatgagtgagaacaaacgatgtttggttttccattcctgagttatttcacttagaataatagtctccaattccatccaggttgctgcgaatgccattatatctttcctttttatggttgagtagtattccatggtatatatctaccacattttctttatccactcgttgattgatgggcatttgggctggttccatatttttacaatcgcaaattgtgctactataaacacgtgtgtgaaagtatctttttggtataatggcttcttttcctctgagtaaatacctagtagtgggattgctggatcaaacagtagaactacttttagttccttaaggaatctccacactgttttccatgtggttgtactagttgacattcctaccaacagtgtaaaaatgtttctttttcactacatccacttcaacatctgttattttttgagcctcttactgctcagcgttagggaagcccgagggcagaaaggaggagaatcgcagctgatgtaaagcactgtgaggtcaggcatgccaagacaagaaaacaattggtgtcaaaggtgggcacaaaaggtatctgatagagaaggtaatggagtaacctctgtagtgctctggggaaaaaaatggttgtagcccaagaattcccccagcacttgtcatttgagtgatggcaatggaaaggcgtgtgtattagatatcatcccctactttctactaaagcacgccttttatcctgtagatctttctctttttttttaacttttattttaagttacagggtacatatgcaggatgtgtaggtttgttacataggtaaacatgtgccatggtagtttgctgcacagatcaacccatcacatagatattaagctcagcatacactatctattcttcctgatgctctccctccccttacccaccccccaacaggaccctgtgtgtgttgttcccccccaccatgtgtccgtgtgtcctaatcattgagcccccacttataagtgagaacttgtggtgtttagtttcatgttcctgcattagtttgctgaggataatgacttccagctccatccatgtccctgcaaaggacatgatcttgttcctttttatggctgcataatattccatggtgtatatgtaccacattttctttatccagcctatcattgatgagcatttaggttgattccatgtatttgctattgtgaatagtgctgcagtgaacaaacatgtgtatgtatttttacaatggaattatttatgttcctttgggtatttacctggtagtgggacttgctgggtcaaacggtatttctggttctagatctttgaggaatcgtcactctgtcttccacaatgattgaactaatttatacgcccaccaacggtgtaaaagcactcctttttctctgcaacctcaccagcacaccagcatctgttgttttttgactttttaataacgccattctgactgatgtgggatggtgtctcgatgtggttttgatttgcatttctccaatgatcagtgatgttgagcttttcttcatgtgttttttggccacacaaatgtcttcttttgagaattgtcttttcatgtcctttgccctctttttaatggggttgtttgttttttttcttgtaaattattttaagttccttgtagattctggatattagactttggcaggtggacagattgcaaaattcttctcatattctgtagtttgtctgtttactccgatgatagcttcttttgctgtgcagaagctctttagtttaattagatcccatttgtcaatttttgcttttgtcgcaactgcttttggcgtttttgtcatgaaatcgttgcccgtgtctatgtcctgaatggtattacttagatcttactttagggtttttatagttttggactttacatttaagcccttaatccatattgagttaatttttgtataaggcataaggaaggggtccagtttcaattttctgcatatggctagccagttttcccaacaccatttattaaataagaagtccttttcccattgcttgtttttgtcaggtttgctgaagatcagatgcttgtaggtgtgcggtgtaatttctgagttctctattctgttccattggtctatgtgtttgtttttgcaacagtaccatgctgttttatactgtagctctgcagtatagtttgaagttgggtaacatgattcctccaggtttgttctttttgcttagattgtcttggatacttgggctcctttttggttccatatgaactttaaaacagtttcttctaattctttgaagaatgtcaatggtaatttaatgggaatagcattgaatctataaattactttgggcagtatgtccattttcaggatattgattctttctatccatgagcatggaatgtttttccatttgtttgtgtcctcccttatttccttgagcagtggtttgtagttctccttgaggaggtccctcacttcctttgttagccgaatttctggtattttttttttgtagtaattgtgaatgggagttcattcataatttggctctctgcttgcctgttattggtgtataggaatggtagcagtttttgctcattgattttgtatcctgagacttttctgaagtcgattatcagcttaaggagcttttgggctgaaacgatgctgttttctagatataggatcatgtcatacgcaaacaaagataatttgacttcctctttccctatttgagtaccctatatatctgtctcttgcctgattgacctgcccagaacttccaatgctatgtggaataagagtgcatataccacattttctttatccattaatccattcaatgaacgtttggatttcttccacctcttcactatggtgaatagtgctgcaatgaacacgggagtatgcatatttctttgagattttccttaaaattcctttggtatattgctaaaagtaggattgctggatcgtgcggtaaatcagttttcagtttcttgaggaacaattatactctgtctcttttttttattatgctttaagttttagggtgcatgtgcacaacgtgcagcttagttacatatgtatacatgtgccatgttggtgtactgccatttaacaccaggtatatctccaaatgctatccctccccactccccccaccccacaacaggccccagtgtgtgatattccccttcctgtgtccatgtgttctcattgttcaattcccacctatgagtgagaacatgcggtgtttggtattttgtccttgcgatagtagctgagaatgacggtttcagcttcatccatgtccctacaaaggacatgaactcatcattttttatggttgcatagtattccatggtgtatatgtgccacattttcttaatccagtctatcattgttggacatttgggttggttccaagtctttgctattgtggatagtgccgcaataaacatacgtgtgcatgtgtctttagagcagcatgatttatagtcctttgggtatatacccagtaatgggatggctgggtcaaatggtatttctagttctagatccctgaggaaccgccacaccgacttccacaatggttgaactagtttccagtcccaccaacagtgtaaaagtgttcctatttctccacatcctctccagcacctgttgtttcctggctttttaatgatcgccattctaactggtgtgagatggtatctcattgtggttttgatttgcatttctctgatggccagtgatgatgagcattttttcatgtgttttttggctgcataaatgtcttcctttgagaagtgtctgtttatatcctttgcccactttttgatggggttgtttgtttttttcttgtaaatatgtttgagttcattgtagattctggatattagccctttgtcagatgagtaggctgcaaaaattttcccccattctgtaggttgcctgttcactctgatggtggtttcttttgctgtgcagaagctctttagttgaattagatcccatttgtcagttttggcttttgttgccactgcttttggtgttttagacatgaagtccttggccatgcctatgtcctgaatggtaatgcctaggttttcttctagggtttttatggttttaggtctaacatgtaagtctttaatccatcttgaattaatttttgtataaggtgtaaggaacggattcagtttcagctttctacatatggctagccagttttcccagcaccatttattaaatagggaatcctttccccattgcttgtttttctcaggtttgtcaaataacagatagttgtagatgtgtggcattatttctgagggctctgttctgttccattggtctatatctctgcttcggtacgagtaccatgctgttttggttactgtagccttgtagtatagtttgaagtcaggtagcgtgatgcctccagctttgttcttttggcttgggattgacttggcaatgcgggctctttcttggttccatatgaacgttaaagtagtttttcccaattctgtgaagaaagtcactggtagcttgatggggatggcattgaatctataaattacattgggcagtatggccattttcatgatactgattcttcctacccatgagcatggaatgttcttccatttgtttgtatcctcttttatttccttgagcagtggtttgtagttttccttgaagaggtccttcacctcccttgtaagttggattcctaggtattttattctctttgaagccattgtgaatgggagttcactcatgatttggctctctgtttgactgttattgttgtataagaatgcttgtgatttttgcacattgattttgtatcctgagactttactgaagttgcttatcagtttaaggagattttgggttgagacgatggggttttctagatatacaatcatgtcatctgcaaacagagacaatttgacttcctcttttcctaattgaatgccctttacttccttctgcctgattgccctggccagaacttccaacactatgttgaataggagtggtgagagagggcatccctgtcttgtgccagttttcaaagggaatgcttccagtttttgtccattcagtatgatattggctctgggtttgtcatagatagctcttattattttgagatacatcccatcaatacctaatttattgagagtttttagcatgaaatgttgttgaattttgtcaaaggccttttctgcatctattgagataattatgtggtttctgtccttggttctgtttatatgctggattacatttattggtttgcgattgttgaaccagccttgcatcccagggatgaagcccacttgaccatgatggataagcttttggatgtgctgctggattcggtttgccagtattttattgaggatttttgcatcaatgttcatcaaggatattggtctaaaattctctttttgttgtgtctctgccaggctttggtgtctggatgatgctggcctcataaaatgagttagggaggattccctctttttctattgattggaatagtttcagaaggaatggtaccagttcctccttgtacctctggtagaattcggctgtgaatccgtctggttctggacattttttggttggtaatcaattaatgattgcctcaatttcagagcctgttattggtctattcagagattcaacttctttctggtttagtcttgggagagtgtatgtgtcgaggaatttatccatttcttcgagattttctagtttatttgtgtagaggtgtttacagtattctctgatggtagtttgtatttctatgggattggtggtgatgtcccctttatcattttttattgcatctatttgattcttctctcttttcttctttattagtcttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtgccagagattctggtatgttgtgtcttttttctcattggtttcaaagaacatcttcatttctgccttcattttgttatgtacccagtagttattcaggagcaggttgttcagtttccatgtagttgagcggttttgagtgagtttcttaatcctgagttgtagtttgattgcactgtggtctgagagacagtttgttataatttctgttcttttacatttgctgaggagagctttacttccaactatgtggtcaattttggaataggtgtggtgtggtgctgaaaagaatgtatattctgttgatttaggggggagagttctgtagatgtctattaggtccgcttggtgcagagctgagttcaattcctggatatccttgttaactttctgtctcattgatctgtctaattttgacagtggggtgttaaagtctcccattattattgtctgggaatttaagtctctttctaggtctctaaggacttgctttatgaatctgggtgcttctgtattgggtgcatatatatttaggagagttagctcttcttgttgaattgatccctttaccattatgtaatggccttctttgtctcttttgatctttgttggtttaaagtctgttttatccgagactaggattgcaacccctgcctttttttgttttccatttgcttggtaggtctgcctccatccgtttattttgagcctatgtgtgtctctgcacatgagatggatttgctgaatacagcacactgatgggtcttgattctttatccaatttgccagtctttgccttttaattgtagcatttagcccatttacatttaaggttaatattcttatgtgtgaatttgatcctgtcattataatgttagctggttattttgctcgttagttgatgcagtttcttcctagcctcgatggtgtttacaatttggaatgtttttgcagtggctggtaccagtttttcctttccatgtttagtgcttccttcaggaactcttttagggcaggcctggtggtgacaaaatctctcagcatttgcttttctgtaaagtattttatttctccttcacttatgaagcttagtttggctggatatgaaattctgggttgagaattcttttctgtaataatgttgaatattggcccccactctcttctggcttgtagagtttctgctgagagatctgctgttagtctgatgggcttccctttgtgggtaacccgacctttctctctggctgcccttaacattttttccttcatttcaactttggtgaatctgacaattatgtatcttggagttgctcttctcgaggagtatctttgtggagttctttgtatttcctgaatttgaatgttggcctgccttgctagattgaggaagttctcctggataatatccttcggagtgttttccaatttggttgcattctccccatcactttcaggtacaccaatcagacgtagatttagtcttttcacatagtcccatattttttcgaggctttgttcatttctttttattcttttttctctaaacttctcttctcgcttcatttcattcatttgatcttccatcactgataccctttcttcaagttgatcgaattggctactgaggcttgtgcattcatcacgtagttcttgtgccatggttttcagctccatcaggtcttttaaggacttctctgcattggttattctagctagccattcgtctgattttttttcaaggtttttaacttctttgccatgggttggaacttcctcttttagcttggattagtttgatcatctgaagccttcttctctcaactcatcaaagtcattctccgtccagctttgttccgtggctggtgatgagctgtgttcctttggaggaggagaggcgctctgatttttagagtttccagtttttctgctctgtttttttcccatctttgtggttttatctaccattggtgtttgatgatggtgacgtacagatggggttttggtgtggatgtcctttctgtttgttagttttccttctaacagacaggatcctcaggtgcaagtctattggattttgctggaggtccaatgcagaccctgtttgtctgggtatcagcagcagaggctgcagaacagtggatattggtgagcagcaaattttgctgcctgattgttcctctggaagttttttctcagaggagtacttggccatgtgaggtgtcagtctgcccctactggggggtgcctcccagttaggctattcaggggtcagggacccacttgaggaggcagtctgtccgttctcagatcttcagctgcatgctgggagaaccactactctcttcaaagctgtcagacagggacatttaagtctgcagaggattctgctgccttttgtttggctatgccctgcccccagaggtggagtctatagagggctccacccagtttgagcttcctggccactttgtttacctactcaagcctgagcaatggcaggcgcccctcccccagcctcgcttatgccttgcagtttgatctcagactgctgtgctagaaatgagcaaggctccgtgggcataggaccctccgagccacacatgggatataatctcctggtgtgccgtttgctaagactgttggaaaagcacagtattagggtgggagtgacccaattttccaggtgccatctgtcacccctttctttgactaggaaacgaaattccctgaccccttgctcatcccaggtgagacaacacctcgctctgcttcagctcatgctcagtgcactgcacccactgtcctgcacccactttccaacactccccagtgagatgaacccagtacctcagttggaaatgcagaaatcacccgtcttctgcgtcgctcatgctgggagctgtagacgggagctattcctattcggccgtcttggctccaccccccccaaactgtgtttcatattgcttgcacatttaacatttccactaactgtgcacaaggttccaaattctccacatccttgacaacacttgttatttttgtttttgatatttgccatcctaatgaatgtgaagtgatatgtagatttaatttgcatttccttaatgattagtaatgttcagcttcttttcgtagactttttggccatttgattagttttgcaaaaaggtctattcaagtcctttttccgtttttaaaattttattttagattcagggggtacttgtgcaggtttgttaaatgggtagattgtatgatgctgaggttgggcttctaatgttcctgtcccccaagtagtaaaccctgtattcaatagatggtttttcagcccttttccccctactttcttcccccttttaaaatccccattgtttagtgttcctgtctttgtgcccatgtgtactcaatatttagctcctgcttataagtgagaacatgtggtatttagttttctgtttctgtgttaattcacttaggataatggtctccagttgcaactatgttcctgcaaaggacatgatttcattctttttttatggctgtgtggtattccatggtgtatatgtactatatttcctttatctaatccaccactgatggacacctaggttgattccaggtctttgctgttgtgaatagtgtggtgatgaacatatgagttcatgtgtctttttaatataatgatctattttcctatggatatgtagctctgttttaagttctttgaaaaatcttcagactactttccacagtggctggacagatttacatgcccaccaatagtatacaagttttcccttttctctgcaacctcaacaaaatctcttattttccaactttttagtaataaccattttgactggtgtgagatgatgtctcattgtagttttgatttgtatctttctgattattactgctgagcattttttcatatgttttttggctgcttttttgtcttcttttgagagatttttgttcatgtactttgctcgtttcttaatgatgttatttgttttactctttttgatttgttcaagttccttatagattctggatggtagtcctttgtcagatgcatagtttgcaaatattttcttcattccattctataggttgtcagtatactctgttgatagtttcttttgctgtggagaagctatttaatttaattagatctcatttgtcaatttttgttttatttgcatttgcttttgagaacttagtcataaattctttgcctaggccgatgtctagaagggtatttcccagggtttcttctaggacttttatagtttaaggtcttgcatttaagtctttaatccatcttaagttaagtatggtgagagatagtggtcccggttcattgttctgtacgtggttagccagtttttccagctccattttttgaatggcatgttctttcctcactgtttttttttttgattttgccaaagatcagttggttttaggtgtgtggctttatttcagaggtctctattctgttccatcggtctatgtgcctgtttttgtaccagtactttactgttttggttagtattgcctatagtatagtttgaagttcggtaatgtgatgcctccatctttgttctttttgcttaggattgccttggctattcaggctcttttgtggttctatatgaattttagaatagttttattctaatcctgtgaaaaatcacattgataatttggtaggaataacattgaatctatagattgctttgctttgcctatttttaaatggggttatttgtttttgttgttgagctgaaaaagttctttatacattctggatattaaccctgtatcagattacgatttgaaaatattttcttgcattccatacattgcctttccattctattgattgtatcctttgatttacagaagttttgaagttgtatgtagtctcaattgtttatttttgcttttgttacctgtgcttttgttgtcatatgtaagaaatcgttaccaaatccagtgtcatgaagactttttccctatgtttttgataaggtttgcctgtgtccccactcaaatctcatcctgaattgtagtttccataatccctgtgtgtcatgggagggactcagtgggaggtaattgaatcatggggtcggttaacttcatgctgttctcatgatagtgagtcagtttgcaggagatctgatggttttataagaggcttttaccccttttgcttggcatttctccttcctgagaaactttctgattgtaagtttcctgaggccttcccagccatgctgaactgtgagtcaattaaaccactttcctttttaaattacccagtctcaggtatgtctttattagcagtgtgggaagagactaatacaattttcttctaagagtttatagttttaggtcttatgtttaggtctttaatccatttttagttaatttttgtatatggcttaaggttaggattccactttaacctttttctgcttaagagaagcggtttcactttgtcacccacactggagtacagtggcctaatcaaagctcattgcagccttgaactcttattcttaagcaatcgtcccatctcagcctctcaagtagctgggattacaggtggaagctgccacatctggcccattttattcttttgcatgtaggttctcagttttatcaacagtgtttgttgaaaagactgttctttttttttcactatgtggtcttggcactcttgttgaaaatcatttggccatatacacaagagtttatttatgggctctatattctgttccattggcctatatgtctgtctttgaaccagtaccacaatgttttgattactgtagcatttttgtgtattttaaaatcaggaaaagtgagaccttcaactttgctcttctttttcaagattgttttggctattcagggtccttgaaatttcatatgaattttaagatggtttttcctatttctgtaaaaaatgtcactaggattttgatagggattgcactacatctatagattgctttgggtagtatgaagttgaaacaatattaagtcttctaatccaaaaacacaggattctttttttccatttacgtgttatctttgatttctttgagcaatgttttttagttttcagtgtgtaagtccttcaccttggttaagtttgtccctaagtgttttattatttttgaggctattgtaaattgtattgttttcttaattatctttttgtactgttcactgttagtagtacataggaaaaaaaaccttcttttttgtgatgattttgaaccttgcaactttgctaaatttatgtattaattatagcagtttttaaaaagaatacttggggttttctacatataagattattctaagtgaagtaactcaggaatggaaaaccaaatgccatatgttctcacttataactgggagctatgctgtgcatatgtaaaggcatacagagtggtataatggactttggagactcagaagagggagcatgggagggggtgaggggtaaaaacaactacatgttgggtacagtgttcaccacttgggtgataagtgcactaaaatctcagacttcaccactatacaattcatacatctaataaaaaaccacttggactccaaaagctattgaaataaaaaatattttaaaaagattatgtcatatgaacagacataattttacttcttcctttccagttttgacccttattatttattttttgtagtaggattattttattggccatattcactgatggactctcctattgaactgaataatctttaaacacattatatgtatcccctcagacaacaacaatggtgacattttcatatattattattttttattatagtttaagttctggggaacatgtgcagaatgtgcagttttgttacataggtatacacgtgccatggtggtttgctgctcccatcaacccatcacctacattaggtatttctcctaatgttatccctcccctagcccctgaccccccaacaggccccggtgtgtgatgttcccctccctatgtccatgtgttctcagttcaactcccacttatgaatgaaaacatgcagtgtttgattttctgttcttgtgatagtttgctgagaatgatggtttccagcttcatccatgtccctgcaaaggacattaactcatcctcttttatggctgcaaagcattccatggtgtatatgtgccacattttcttaatccagtctatcattgatggacatttgggttggttccaagtctttgctattgtgaatcatgccacaacaaacatacatgtgcatgtgtctttatagaagactgatttataatcttttgggtatatacccagtaatgggattgctggttcaaatggtatttctagttctagatccttgatgaatcgccacactgtcattgaactaatttacactcccacccacagtgtaaaagcgttcctatttctccacatcctctccagcatctgttgtttcctgactttttaatgattgccattctaactggcgtgagatggtatctcattgtggttttgatttgcatttctctaatgaccagtgatgataagcatttttcacatgtgtcttggctgcataaatgtcttcttttgaaaattttaaaattctatgtgtcatgagtccagtacagtcttagaacacaggcattattttattcctgcactgtgtttatgggacttggctaacaaatagatgggacatcatatccctctttaaaacatggaaggataatgtgaaaaggtagaaaaatatataggtgtcttcttcttccaaaattattcgtctaacagatgaaatgctaatagatgaaactgttgatccaagagaagaatgagagcttcacacccctaaatcacgaaatagtatggaattgttaacccattccctggattcctctcttccacatcttctaattcagtcctttcaaagtgcagctcttgtcttgtctttttcttgacaattttcttttaattaagtttaatttataaatggaacccatgttacatagccttcttgggaacagagtatcacaagtcacctggaataatcatgcaaagctcaagtctagaaatctagaatttgttggattctagaataagatatttccaaagagtgaacaggcataggggtcatggctttttaaaattacttcttaaagatgcattgagaaattatagacaaatgaaaatggtgtatattcaaggtatgcaatgtgatgcttcgatatacattgtaaaataattaacacaatcacactaacttattcatctccttacacagttaccgtgtgtgtgtgtatgtgtgtgtgtatacagtaagaatagctaaaatctagtctcttagcatatttcaagtatacaatatagtattattaattattgtcaccatggtgtacattgagtctccagaacttattcatctcataactggaagtttgtactcttgacaaacatttccccatttttcccacctctgaccaccagtaacaacccttctactcttttcctatgagttcaacttttttagatttcttgcatataagagaaatcgtacagtatttgctttctgtgtctggctcttttcgtctaggataatgttctccaggttcatccatgctgtcacaaatggtagaattaaggctaaattgtgtgtgtgcgtgtgtgtgtgtgtgtaaaactcattttctttacccattgatggaaacttgggttgtttgaatattttgactattgtgaatattgctgcaatgaacatgaaagtgctgatatctctttgaaacagtggttttatttcctttggatgtatacccagaagtgtaattgctggattatatggtagatctatttttaattattttaagaacctccatactgttttctctaatggctgtagcaaattatatttgcagtaacagtgtacaagggttgctttttctcaactcccttgccaacactttttatctcttgacattttgatagtagtcatgctaacagatatgaagtgacatttcatttgattttaattttcattcccttgggtaggagctgtaaaagtgaggctgcttgacgcatgcacaaactccttctagggagaatttgcagacctgaattaatcactggagtgagccaggggagatggcatggaaagtgcccacattctcattcaggctcccaaaggcctactgtttatctgccccatcagctcctggaatcaggttagtcagacatccaatcctctaacagcaactggaaaagtgtatagacaaataccaggaagaaactgggagcttgaagcttttgtcagttttctcttttttgagtacagaggtgaagaaaggggtaggatagtcactgaacctgctcacacacccgtttaaaactgtctctttgttctctgtggtctggggagatctggtaatgccaagtcttttctgcttccagagctgggtgatttaggacccaaacactgtgaggagagcagtaaaagttgaaatgctctatgtgtggtccaaagctttcactctttagggagaagttgggagttagggatttcttcctgattgtaaggtgctgtgcttgtgatgggatttgtgcatgaatatatcttagcctttcctacctaattggaagtgaatattttctcagctgcctggagtacaggagtcaggatttctggatttctctcagaggaaattgatccatgtgtagaacttatttggtgcatctgtggtaggaaggaaagcaggagcctcctattcttccatcttcctgatgtcacttccctaatttccttttcttgtagtgtccttgtctggctttgatatatcactgctgctgcctcacaacaagtttgaaagagttctctcctcttaacatttgtataagagttcaagaaggacttttattatttcttctctaaatggttggtagaattcacctaagaagacatgtccttggctttttaataatgggagatttttgagtactgattcaatctctttacaattactatctactattactattgttattactttactattactattattgctctgtggttttttatttcttcatgattcaacttgatagattgtatgcttttagaacgttatccacgtcttctaggttatccaatgttttggcatataattgttcatagtagcctcttataatccgttatatttctgtgctattagttgtaatgttcctctttcattttttattttattaacttgtgtctttttctttgttagtctagctaagggtttgtcaaatatttaattttttcagaaaaccaacaactaaagttttatttttatggtgttttttagtctctattatacttatttatgttctgatctgtgttatttcctttcttttactaactttggactttgttttctttttctagatccttgaggtataacattactttttttatttgaattctttcttccttttaaatgtaggtatttatcactgtaaatatccttcatagaactgcttttgctgcattccacgagttttggtatactgtgttttcattttcatttgtctcaagatactttttaatttctcctttgatttattctttgattattggttattctggagcctgttgtttaattttcacatatttgtgacattttcagtttttttcctgttactaatttctggtttcatcctgtcgtagttggaaaagatacttgatatgattgcaatcttcttgaattgttaagacatgttttatggcacaacctattatcctggagaatgttctatatgcccttgagaaaaatatgtattctactgctgttggatataatgttctgtatgtgttcgttagatccatttgatctaaaatacagttcaagttcaagatttccttactgattttctgtctggatgaactatccaatgttgcaagtttggtattgaagtcctttactattattgtattgcgcctatttctccctcagttctgttaacatttgcctaaatatttaagtgctctaatattgagtgcatatgtatttacaattgttatatcctcttgatgtattggcccttttatcattacatagtggtgttctttctctcttctgatagatttttactgaaagtctattttgtctgttataagatagctactcctgctctctcatagtttcaacttgcctggaatatttttaccgtctattcacttcagtccatgtgtgtttttaaagcttaagtaagtctcttgtaaacagcacagtgttttgtcttgtcttattattatttttttcattcattcagctgctctatatcttttgaaatggaataaacccactgatcagaaggtctgtacattctgatgaatggactttcttttttttgagacagagtttcgctctggttgcccatgctggagtgcaatggagtgatcttagctcatccgggttcaagcgattctcctgcctcagcctcccgagtagctgggattacaggcatgtgccaccatgcccagctaattttgtgtttttagtagagatggggtttctccatgttggtcaggctgttctcaaattcccgacctcaggtgatccacctgcctcggcatcccaaagtgctgggattacaggcatgagccaccatgcctggccgatgagtggatttttataaaaacagaatccagtgatatgcttagtacaagagatttactttatatttaatatgaaagaaaattaaatttctgtaccccaaacccactataccaatgagaaagttaagcttggaaacttagtcatgcaaaaaaacgtcctcttttagttcccacatagctgtaaatttcacatgattactttatcttacatagaatatggatctacccagcacaagatgaatgcatagtctttcccccgcactcttctcttttcagaggtaaaatgtggattcagtgagtgctattcaaagcctcacaagaatgtaacactgccctcacctcttacacctccattttccccctcctttccctcctgcctgctctttccccgttaaatattgcagtcctcaaacactctttggacaaagcacaggctacacatcctactgtgacttgtgtgctttttcctaggtgtgtcctcaaccttggcaaaataaaactctaaatcgattgagatctgtctcaaatactttttggtttacagttggcaacccctaagggattttgaatggagtttggtcctttggcttgcagcaattctcctagcaaggatctggtaccagctggaagctctttattgctctgactgattgaactatttgctgaaatatgggagcttctctctccagagatccctgatctcccaattttttttggttgaattttgagttgtattctgttgtagaactcatttccttggagttttcttcttttgtgcaggtgaaaatcagtcttcacattggcctccatcttcaagtaagaagctggtttggggtttcatttggggatttgatagctgaaggtcaaggtttattgtcagctggctataacttttatgctcagagatctcaactgtatgtaaattgtgtgatcactttttttctgtttttttttttgtttgtttgtttgtttcagttcatcttccactagatttgaccaactcctggccccctctactgttgactgaaattagaaagtcaaaattccatctctaaatagaaaactggccagttaagaaagttaaaaaatttgactacctgaaaagttttgcccacataacaaggccaccttttactaacttttgctaaccaagtcttttcctttcttcttccaataacctgtcttgccactaaaactatttttttgtttttgtttttttgtgtgtgtttttttacataccttgaaactgcatgctttctttcatttcaatatggtatatgagcttctgttatttattgggaaattgggccttcattctgaaggttcctatgaatatatattaaataaatttctatgccttttctccaattaatcaattgcctcattccagtgatttttcagtgaacctttgggcacaagcagtcatgacccccacagtttggtgcagcaagcaaggtgactaaagctgctcttctcctctggaacccatggtgaagggaacccaggaaactgatctgccaacaaagggggaagactttctttttttatttattttattttattattattatactttaagttttagggtacatgtgcacaatgcgcaggttagctacatatgtgtacatgtgccatgttggtgtgctgcacccattaactcgtcatttaacattaggtatatctcctaatgctatccctccccccttcccccaccccacaacagtccccggtgtgtgatgttccccttcctgtgcccatgtgttctcattgttcaattcccacctatgagtaagaacatgcagtgtttggttttttgtccttgcgatagtttactgagaatgatgatttccaatttcatccatgtccctacaaaggacatgaattcatcattttttatggctgcatagtattccatggtgtatatgtgacacattttcttaatccaatctatcattgtcagacatttgggttggttccaagtttttgctattgtgaatagtgccgcaataaacatacatgtgcatgtgtccttatagcagcatgatttatagtcctttgggtatatacccagtaaggggatggctggttcaaatggtatttcaagttctagatccctgaggaatcgccacactgacttccacaatggttgaactggtttccagtcccaccaacagtgtaaaagtgttcctgtttctccacatcctctccagcacctgttgtttcctgactttttaatgattgccattctaactggtgtgaaatggtatctcattgtggttttgatttgcatttctctgatggcctgtgatgttgaacattttttcatgtgttttttggctgcataaatgtcttcttttaagaagtgtctgttcatgtcctttgctcactttttgatggggttgtttgtttttttcttgtaaatttgttggagttcattgtagattctggatattagccctttgtcagatgagtagactgcaaaaattttctcccattttgtaggttgcctgttcactctggtggtagtttcttttgctgtgcagaagctctttagtttaattagatcccatttgtcaattttggcttttgttgccattgcttttggtgttttagacatgaagtccttgcttgtgcctatgtcctgaatggtaatgcctaggttttcttctagggttttcatggttctaggtctaacatttaagtctttaatccatcttgaattaatttctgtataaggtgtaaggaagggatccagtttcagctttctacatatggctagccagttttcccagcaccatttattaaatagggaatcctttcctcattgcttgtttttgtcaggtttgtcacagatcagatagttgtagatatgtggcgttatttctgagggctgtgttctgttccattgatctatatctctgttttggtaccagtaccatgctgttttggttactgtaggcttgtagtgtagtttgaagtcaggtagcatgatgcctccagctttgttcttttggcttaggattgacttggcgatgcgggctcttttttgattccatatgaactttaaagtagttttttccaattctgtgaagaaagtcattggtagcttgatggggatggcattgaatctataaattaccttgggcagtatggtcattttcatgatattgattcttcctacccatgagcatggaatgttcttccatttctttgtatcctcttttatttcattgagcagtggtttgtagttctccttgaagaggtccctcacatcccttgtaagctggattcctaggtattttattctctttgaagcaattgtgaatgggagttcactcatgatttggctctctgtttgtctgttattggtatataagaatttttgtgatttttgtacattgattttgtatcctgagactttgctgaagttgcttatcagcttaaggagattttgggctgagacaatgggattttctagatatacaatcatgtcatctgcaaatagggacaatttgacttcctcttttcctaattgaatacactttatttccttctcctgcctaattgccaaagggggaagactttcttaccagctaggctcctggcctctctctctgaactccaggtgaatggatggtaaaatcgtctcgtctgcaaagttttaatttttaaaaaaggatttttgtgactagccttggtatagtgactctggtgtatttttggtactttgtgctatgaatattcactattggaataaagtatattattgaaaattctgattgtcaatggccaaaagataaagattttagagatatcttattctaaacaattgatgagaaaattaaatttaaaaaggacacatagtagtgtcatgagacctcactaaattgaaaagcaaaaaaaaaaaaaaaattatttttgacttgaaagaaagttagaatcctttccaagctcaaaactgcctgctctagatttcttcttggaataacagtagagacttccccatgctgtagtttagtagctaaggttttgccctttcaccatagcagcctgtgttcagttcccagccagggaatgagtcttttttcatttgatatttgcaagaattttgccacttattgatccctttccctttgatggactgcttatgatttcctgtcttgaattttaccttctctaaggtatcttttgggtgattctggatcttgaaaaacctacttgccaccgctttggagacatctcatgcatctctggttaagtcataatcttggttaaggcacttgggaggatacctttggtaaagaacttcaaaagccaaaaatattggctgtttatcctggctaaaatctgataataagagatttaaaatggttgttttaaaaagaactctatggttaaaagtcagtttaattaaaagctgatatccaagctatatattaaatatttaaaggcctttatgccttttctttttatggatcctgatttggggaattttttttttccagctgactgaagtcttttttaaaatccttttgtaaaataaatttacattttaagaaaaatttctatttgtaagggagtctgcctgtgtacattaaaaccacttaccattgctgggaaaactggctagccatatgtagaaagctgaaactggatcccttccttacaccttatacaaaaattaattcaagatggattaacgacttaaatgttagacctaaaaccataaaaaccctagaagaaaacctaagcaataccattcaggactcaggcatgggtaaggacttcatgtttaaacaccaaaagcaatggcaacaaaagccaaaattgacaaatttgatctaattaaactaaagagcttctacacagcaaaagaaactaccatcagagtgaacaggcaacctacaaaatgggagaaactttttgcaatctacccatctgacacagggctaatatccagaatctgcagattactcaaacaaatttacaagaaaaaaacaaacaacccatcaacaagtgggcaaaggatatgaacagacacctctcaaaagaagacatttatgcagccaacagccacatgaaaaaatgctcatcatcactggccatcagagaaatgcaaatcacaaccacaatgagataccatctcataccagttagaatggcgatcattaaaaagtcaggaaacaaaagatgctggagaggatgtggagaaacaggaacacttttacgctgttggtgggactggaaaccagttcaaccattgtggaagtcagtgtggcgattcctcagggatctagaacttgaaataccatttgacccagccatcccattactgggtatatacccaaaggactataaatcatgctgctataaagacacatgaacacatatgtttattgaggcactattcacaatagcaaagacttggaaccaactcaagtgtccatcaatgatagactggattaagaaaatgtggcacattaggctgggcacggtggctcatgcctgtaatctcagcactttggaaggccgaggcgggcagttcatgaggtcaggagatcgagaccatcctggctaacatggtgaaaccccgtctctactaaaaatacaaaaaattagctgggcatagtggcaggcacctgtagtcccagctactcgggaggctgtggcaggagaatggcatgaacccgggaggtggagcttgcagtgagccgagatggcaccactgcactccagcctgggtgaaagagcaagactccgtctcagaaaaaaaaaagaaagaaaatgtggcacacatacaccatggaatactatgcagccataaaaaaggatgagttcatgtcctttgtagggacatggatgaagctggaaaccatcattctcagcaaactatcacaaggacaaaaaaaccaaacactgcatgttctcactcataggtgggaattgaacaatgagaacacttggacacaggaaggggaacgtcacacaccggggcctgttgtggggtggggtgagggggagggatagcattagaaggtatacctaatgtaaatgacgagttaatgcgtgcagcacaccaacatggcacatgtatacatatgtaacaaacctgctgtgcacatgtaccctagaacttaaagtgtaataaaaaaaaataaaataaaataaaaaataaaacctctcaccattgctttaaatttatgtcatatgcttgttgaagcacttttcctatcttatctgcaatttacttaccctggtttttgccctgggtttgagcaaataacgatacaatattaagaataacttcttagttctgaactttgacttgtaaattctctatcttatttcatctaggagttgtccctttagaaatgcaaatttaaggtgtcatggctaacaattgcctagaacaatgaaacagttaattaaaagagattgagcatctaaagcgggggaggggaactttaaaaactagcaaatgaaaaatcttataaatctataaaatctgtttctgtctatatgtcttcatgtctatgtgtttatacatgtcatgtgtttgtgatgtttcactaccaaaatatctaaaaagctctaattaataggcttatagacaaaagtaagtgctcaaatatttcatcagaaaaataaaaactttatttgaacaccttttcgttcttgtgactgtaataacctttagtaagtaaagctaatttaaattattggtaaaatagaatgaaaatgtcttcaaaatttaatttaatgatttgatctgatctggtcaggcaggtcagatactgtctttgttagatattttaaggtcataaactgcttctgtgacattttaaataattgtttgagttgtctatcttatagtaagccctggggaaatgtgaagttctccctggcccaactatgctacttgactatgttgggaagggttagacattatctgcaactccgtcttttgtcctgggttctgcatctgatacataattaaaattgcttacgtcctaggttgttcactaaaaaggagttgcttagagtaatacactaattactatatatgattaaaatgactagtataagagaaacatttctatatagagagtacataaggaaattaggatgtgtttggaaaaaggggttatagaaagtcatggaaatatgttctttgctaaagggaaagtaattttgtctagtttagaggttttaacgatgagtttgtttatgtgattttattaaaattagctttactgttaatacattatgcaaagataaaacttgattttctcttttgaacaaggttttcatgtaatattaagagatagtaaagatttttgtttgtgttttgagtaaactgcaaaaaagaggggagagaggacagatttagttgcccttttactgtctttcttaggtctcattatttgagaaattgagtttcctctctatcaaataataaaagtttttgctttttaaaaatctttaaattattactttggctaaaagaatattttgcagtgacctgtgatcctattttgtgatatcaaatgttttaaacctttgatatttaataaacattccaaaatcaagtctaaattcagtctttttgacttcattaactcttttaaatgttagattgtctgaattccaaagaagacatatttggcttatttgataggttaaaatcatacaggaagcatcgtcaaatatgaaatgtttagctttccttgggttctatttatataagcttgtaattaatatatgttccaaaactgtatgagattcctgtaattctggtatgtcttagtatatgttaccagtaatagttataattattatgttaaattgttgtatgccacagggaaaaaaaaacaaattttcatgtcagttgtgtctttaaccatgactgtcctaagattttggtcatcacaattattattttacttttattcttctaaaaaaaaggctgtttataaaaaagctgcagccccaaacgtgcttttttaggggaattcatgaaaaggactctgacaggtgttcttgaatgcaggtttctgataactttggagactgtgccatagtactagcaaataaaacagaaacaaaaacttccaagactctaattaaaagtctgatatgttcatgagtattgctaacccaatatcaagtggaatgacttaattacatgggactgaacaaacagaagactgaaataatttttatgaccattttttttgaaacattgctaaatatttctgatgtttttcagagtcaagaaaactaaccttttgagctacttatagcttttcttttaacaattgagtaaagtatactcttgtgagcaaaatttgaagcatatttctatttctttctctctacctgatttcttcagaattcggaaaccgtttgtgcatcttcttaatttctggcaatatagttatttgcataaattcaacaagaatctatttccttttataacagaacaccattggagatactggttattttaccaaggccttgactgaaatggtatatattcagatgtggagcagactgctttgaaaaatagaagttgacttatagagctgataaaagcaccttggaaaacctggccttgtaccttgtctatgtggttcctttacagggttcctgacctgtggaaagtaaatatgtcactttctgacagacccaggaaccccaagttatcttggtaccacaagaagagaagaattcactcaattcattcaagtatctacagacacagatgaatccttggctgggttcaggaggcttttgaaaagtcaaatctgagattccttatttttaagaaagttccagcaaagccaatttaaagaaagcctatgtggaaaatacttattcttgttgcattttatgcaaataatcaggccaagtataataagactgcaacttattttgcaaacaaattgattccattatgatttgtctttaataaaaatgaggaagtgaagagagaaaaatcacgtttcaaaagaaactatagtacacctcttattagattcaagccttggcctttgttttccacttttattatttgtctatggtttaactagattgaatcctgaattccttacaggctataagtctccaaactgttttcaattttttttctctcccatttttctgacttggaatcactggaaattaaaactatgcttttcttaaagctctgtaggctgaagctagacaacttaaactttgggagaaataacagcaacttatttatatacataaaccacttttttgcctgcctaatgatgtatggactttgcaatatagcctaaatcagttttccagggttgctttcccctttattgctataatctggatttggtcctttttttctccacctttcttcctcctgctatttctctccatgggatgtgagacttcacaactttctagaatgaggcttcctaacaacatgggacctaccatcctaggaataaaccatcctagcaatgaaggatcagaccaaacccattaccggagactcattttcttctacaatgctttctccaaaagattttgaagaacaagggggaaacatgaaaggaaaataaaatctcaggacccaaactcactatgccaaagagaaagttaagcttgggaactgagtcatgcaaaaatcgcaaaaatctgccttcctttttgttcccaggtaactgtaaatttcacatggttactttatcttacatcaagtgtaatgtatgcagcacaagacgaatgcataattgactgtccccactcctctcttttcacatgtaaaatgtgaattcagtgagcacaaatcaaagcctcacaagaatgcaacacttggttcaccacctaccccactttttctttctttgtttcccttccttttcctcctgcccactctttcccctttaaatactgaagtgctcaaaatcctctttggagaaagcacaggctacagatcttgctataactcgtgtttctttttcctgggcacatcctcaactttggcaaaagaaacctctaaattgattgagatttgtctcagacactttttggtttacattaaaggcattcatgggctgaaagtgctgagatagaaaaagacatttcatgcaaacagtaattgaaataggcagtagtggctatacttgtatcagacaaaatagattttaagtctaaaactttttgtacagacaaaaaagtcattgtagaatgatgaaaaggtcaattcaaccaaaagatctattgtaaatatataaacatccaatatgagaacacctaaatatataaaggaaatatggacagatctgaagacagaaattcacaggaataaattaatagtaggggacttctatattccattttggaatggatatccagtcagaaaaatcagtaaagaaagaactgacttgaacaacactacagatcaaagccaaaagacgtaagccaaactttccgttcaacagcagaagaatacacattattttcaagtgcacgtggaacattctaccaaatagatcacatttaggttgcaaaacaagtcttaacaaatgcaagaaaatcaaaatcatttcaagtatcttttttggtcacagtggaatctagaaatcaataacagcaagaaaaccagaaaatatacaggtgtggaacctaaacaacatgctcttaaacaatcattgtgtcaaagaggaaatcaaaacgtatctcaagacaaactaaaatgaaagcagaacataccaaaactttttagatgcagctaaagcagtactgaaagggtggtttataccaataaattcctacacgaagaaagaataaagctccccaaaatacaaactaactttccaactcagggaactagaaaatgaacaacaaactaagtctaaagttagcagaaagaggaaataataaaattagaactgaaataaatcaagcggaggatttttaaaaataaaaaactcaacaaaaccaagagtttgttttttgaaaagatgaacaaactcaacaaacctttagttgtactaattaataaaagagagaagactaaaattttaaaaaatcgtaactgaaagaggagacattgcagctgatgccttatgctatggtttgaatgtttgcgtctccttgtaatagtcaggtttctccagaggggcagaaacaatagtatatatgtgaaagagaatttattagggggaattggatcacacaatcagaaaggtaaagtctcataataggccatctgcaagctgaaggaccagagaagcttgtcatgtggctcccagagaagccagtagcctggctcagtacaagtctgaaagcctcaaaaccagggaagccaccagtgcaatcaccagtctgaggccaaagacctgagagcccatgtgaggccactagagcaagtctgaatctaaaagcaggagaaccaggagtctgatgtccaagggcaagagaagaacaaaggcctcctgctctggaaaggagagagagaagaagccagagcaaactgaatatccccatttctgcctgctttgtcctagacaagcccctagtcaatcagatgatgcctgcctacattagggtgggtttttctctctcagtccactgtctcatatgtcagtttccttgggaaacgtcctcacatatacacccatctgcaatgcttcactagccacgtaggcatctctcaattcaatcaatcaagttgacacataacgttaaccatcatacccttccaaaattcatgaaaattagtctttaattcgatagtattagaaggggcctttaggaggtgatcaggtcatgaaggctcctatctcatgaatgggattaaaactgctgtatagaaggcttcacacagcttttgactctttttacccttctgtcccttctgccgtgtgagactgcattattcatttcccaggaggatgtagcaatgaggcaccatcttggaagcagagagcagccctcaccagacgctgaacctaccattgccttgacgttagacttctcagcctccagaagtatgagaaataaatttccattctttataaattacctagtctcagatattttgttacaggagcacaaatagattaagacacctcagtatcaaatggatcataagagattattatgaacaattatatgccaacaaacgggataacctagaagaaatggataaattcctagaaacattataaaaaaaagaaagcccataccaataaaaaataagaaaatttaatccgtaaccagaactatcccagcaaacaaaaccaaggaccaagtaattcacagctgaattctatcaaactgtcaaagaagaattaatacctatctttctaaaagtcttcccaaagatagaagagggaacatttccaaactcatcatagaaggccagtatcagcctgatacccaaaacagacaaagacactacaagaaaactatagtctgatatacctgatgaacatatatgcaaaattattcaataaaatactagaaaactgaatacaaaaacattttaaaaggaacatatcccagttgaataaattccaagtggaatttattcctcagatgtaagaatagttcaatatacacaagtaattcattgtgatacaacgcattaagaaaatgaaagaaaaaatccacatgatcatctgaatagatgcataaaatccatttgacaaagttcaacatccattcatgattaaaactctcaacaaaataggtacacaagcaatttacctcaatacaataaaggatatatatgaaaatcccatagctaacacaataaatgaggaaaaattaaaagctttcactctaagatccagtacaaagcaaggatgcccacgcttgtcacttatttttatttttgtattttattatactttaagtcctggggtacatgtgcagaatggaacgtgcagttttgttacataggtatacatgtgccatggggtttgctgcacccatcaacccatcacctacattaggtatttctcctaatgctatcccttccctagccctccacccccaataggccccactgtgtgatgttcccctccctgtgtccttgtgttctcattgttcaactcccagttatgagtgagtacatgtggtgtttggacttctgctcttgtgttagtttgctgaaaatgatggtttccagcttcatccatgtccctgcaaaggacattaactcatcctttttatggctgcataatatttcatggcatatatgtgccacattttctttatccagtctatcattgatggacatttgggttggttccaagtttttgctattgtgaattatgccacaataaacatatgtgtgcatgtgtctttatagtagactgatttataatcctttgggtatatacccagtaatgggattgcatggtcaaatggttatttctaggtctagatacttgaggaatcaccacactgtcttccacaatggttgaactaattcacactcccaccaacagtgtaaaagcgttcctatttctccacatcctctccagcatctgctgtttcctgagattttaatgattgccattctaagtggtgtgagatgttatctcattgtggttttgatttgtatttctccagtgatgaacacttttccatttgtctgttggctgcaaaaatgtcttcttttgagaagtgtctgttcatatcctttgcccactttttgatggggtttttttttcttgtaaatttctttaagttccttatagattctggatattaggcttttgtcagatggatagattgcaaaaattttctctcattctgtaggttgcctgttcactttgttttattttattttattattattatactttaagttttagggtacatgtgcacaatgtgcaggttagttacatatgtatacatgtgccatgctggtgtgctgcacccattaactcgtcatctagcattaggtatatctcctaatactatccctcccccctccccctaccccacaacagtccccagagtgtgatgctccccttcctgtgtccatgtgttctcgttgttcagttcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttatttatttatttatttatttatttatttattttttattatactttaagttttagggtacatgtgcacattgtgcaggttagttacatatgtatacatgtgccgtgctggtgcgctgcacccactaactcctcatctagcattaggtatatctcccaatgctatccctcccccctccccccaccccaccacagtccccagagtgtgatattccccttcctgtgtccacgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctatcatgaatagtgccgcaataaacatatgtgtgcatgtgtctttatagcagcatgatttatagtcctttgggtatatacccagtaatgggatggctgggtcaaatgctatttgtagttctagatccctgaagaatcgctacactgacttccacaatggttgaacctgtttacagtcccaccaacagtgtaaagtgttcctatttctccacattctctccagcacctgttgtttcctgactttttaatgattgccattctaactggtgtgagatggtatttcattgtggtttcgatttgcatttctctgatggccagtgatggtgagcattttttcatgtgctttttggctgcataaatgtcttcttttgagaagtgtctgttcgtgtcctttgcccactttctgacggggttgtttgtttttttcctgtaaatttgtttgagttcattgtggattctggatattaaccctttgtcaggtgagtagtttgcaaaaattttctcccattttgtaggttgcctgttcactctgatggtagtttcttttgctgtgcagaagccctttagtttaattagatcccatttgtcaattttggcttttgtggccattggttttggtgttttagacatgaagtccttgcctgtgcctttgtcctgaatggtaatgcctaggttttcttctagggtttttatgggtttaggtataacgtttaagtctttaatccatcttgaattaatttctgtataaggtgtaaggaagggatctagtttcagctttctacatatggctagccagttttcccagcaccatttattaaatagggaatcctttccccattgcttgtttttttgtcaggtttgtcaaagatcagatagtagtagatgtgcagtgttatttctgagggctctgttctgttccattgatctatatctctgttttggtaccagtaccatgctgttttgggtactgtaggcttgtagtatagtttgaaatcaggtagtgtgatgcctccagctttgttcttttggcttaggattgatttggtgatgcaggccctttttttggttccataagaaatttaaagtagatttttccaattctgtgaagaaagtcattggtagcttgatggtgatggcattgaatctataaattaccttgggcagcatggccattttcacgatattgattcttcctacccatgagcatggaatattcttcgatttctttgtatcctgttttatttcattgagcagtggtttgtagttctccttgaagacgtccttcacatcccttgtaagctggattcctaggtattttattctctttgaagcaattgtgaatgggagttcactcatgatttggctctctgtttgtctgctattggtgtataagaatgcttgtgatttttgtacattgattttgtatcctgagactttgctgaagttgcgtatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaacactatgtggagtaggaatggtgagagagggcatccctgtcttgtgccagttttcaaagggaatgcttccagtttttgcccattcagtatgatattggcagtgggtttgtcatagatagctcttattattttgaaatacgtcccatcaatacctaatttattgagagtttttagcatgaagggttgttgaattttgtcaaaggctttctctgcatctatttagataatcatgtggtttttgtctttggctctgtttatatgctggattacatttattgatttgtgtatattgaaccagccttgcatcccagggatgaagcccacttgatcattgtggataagctttttgatgtgctgctggattcggtttgcagtattttattgaggatttttgcatcaatgtccatcaaggatattggtctaaaattctctcttttggctgtttctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttattcttgggaggttgtatctgtcgaggaatttatccatttcttctagattttctagtttatttgcatagaggtgtttatagtattctctgatggtagtttgtatttctgtgggatcggtggcgatatcccctttatcattttttgttgcgtctatttgattcttctctgttttcttctttattagtctcgctagtggtctatcaattttgttgatcctttcaaaaaaccagctcctggattcattgatttttcgaagggttttttgtgtctctatttccttcagttctcctctgattttagttatttcttgccttctgctagcttttgaatgtgtttgctcttgcttttcttgttcttttaattgtgatgtcagggtgtcaattttggatctttcctgctctctcctgtgggcatttactgctataaatttccctctacacactgctttgaatgcctcccagagattctggtatgttgtgtcttgttctcattggtttcaaagaacatctttatttctgccttcatttcgttatgtacccagtagtcattcaggagccggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccacttggtgcagagctgagttcaattcctggatatccttgttaactttctgtctcattgatctgtctaattttgacagtggggtgttaaagtctcctattactattgtctgggagtctaagtctctttgtaggtcactcaggacttgctttatgaatctgggtgcttctgtattgggtgcatatatatttaggatagttagctcttcttgttgaattgatccctttgccattatgtaatggccttctttgtctcttttgatctttgttggttgaaagtctgttttatcagagactaggattgcaagccctgcctttttttgttttccatttgcttggtagatcttcctccatccttttattttgagcctctgtgtgtctctgcacgtgagatgggtttcctgaatacagcacactgatgggtcttgactctttattcaatttgccagtctgtgtcttttaattggagcatttagtccatttacatttaaagttaatattgttatgtgtatttgatcctgtcattatgatgttagctggttattttgctctttagttgatgcagtttcttcctagcctcgatggtgtttacaatttggcatgattttgcagtggctggtaccagtttttcctttccatgtttagtgctttcttcaggagctcttttagggcaggcctggtggtaacaaaatctctcagcatttgcttgtctgtaaagtattttatttctccttcacttatgaagcttagtttggctggatatgaaattctgggttgaaaattctttgctttaagaatcttgaatattggcccccactctcttctggcttgtagagtttctcctgagagatccgctgttagtctgatggacttccctttgtgggtaacccgacctttctctctggctgcccttaacattttttccttcatttcaactttggtgaatctgataattatgtgtcttggagatgctcttctcgaggagtgtctttgtggccttctctgtatttcctgaatctgaatgttggcctgccttgctagattggggaagttctcctggataatatcctgcagagtgttttccaacttggttccattctccctgtcactttcaggtacaccaatcagacatagatttggtcttttcacatagtcccatatttcttggaggctttgttcgtttctttttattcttttttctctaaacttcctttctcacttcatttcattcatttcatcttccatcactgataccgtttcttccagttgatcacatcggctcctgaggcttctgcattcttcatgtagttctcgagccttggctttcagctccatcagctcctttaagcacttctctgtattggttattctaggtatccgttcgtctaaattttttctcaaagtttttaacttctttgcctttggtttgaatttcctcctgtagctcgcagtagtttgatcgtctgaagccttcttctctcaacttgtcaaagtcattctccatccagctttgttccattgctggtgaggaactgcgttcctttggaggaggagaggcactctgctttttagagtttccagtttttctgctctgttttccccccatctttgtggttttatctaattttggtctttgatgatagtgatgtacagatgggtttttggtgtggctgtcctttctgtttgttagttttccttctaacagacaggaccctcagctgcaggtctgttggagtttgctagaggtccacctcagaccctgtttgcccaggtatcagcagcagtcggtgcagaacagcggatttttgtgaaccgcaaatgctgctgtctgaccgttcctctggaagttttgtctcagaggagtaccccgctgtgtgaggtgtcagtctgcccctactggggggtgcctcccggttaggctactcgggggtcaggggtcaggaacccacttgaggaggcagtctgcccgttctcagatctcaagctgcatgctgggagaaccactgctctctttaaagctgtcagacagggacatttaagtctgcagaggttactgctgtctttttgtttgtctgtgccctgccctcagaggtggagcctacagaggcaggcaggcctccttgagctgtggtgggctccacccagttggagtttcccggctgcttttttcacctaagcaagcctgggcaatagcgggcgcccctcccccagcctcgctgccagcttgcagtttgatctcagactactgtgctagcaatcagtgagactccgtgggcgtaggaccctctgagccaggtgtgggatataatctccttgtgcgccgttttttaagcctgtcggaaaagcgcagtattagggtgggagtgacccgattttccaggtgctgtctgtcactcctttcattgactaggaaaggaaattccctgaccccttgtgcttcccgagtgaggcaatgcctcgccctgctttggctcgtgcattgtgcactgcacccactgtcctgcacccactgtctggcactccctagtgagatgaacccagtacctcagatggaaatgcagaaatcacccatcttctgtgtcgctcatgctgggagctgtagactggagctgttcctattcggccatcttggctgcccgaccgcctgttcactttgatgacagtttcttttgctgtgcagagtctctttgttttaattagattccattagaaaattttggcttctgttgccattgcttttggtgttttggacatgtagtctttgcccatgcctatatcctgaatggtatcacctaggttttcttctgggaattttatggctttaggtcttatgtttaagtctttaatctatctcaagttaatttttgtataaggtgtaaggaaggagtccagtttcagttttctgcatgtggctagccaattttcccaacagcatttattaaatagggaatcctttccccattgcttgtttttctcagggttgtcagatatcagatgattgtagatgtgtggtattaattctgaggcctctgttctgtttcattggtctatatatctgttttggtaccagtaccatgctgttttggttactgtagccttgtagtatagtttgaagtcaggtagcgtgatgcctccagctttgttctttttgcttaggattgtcttggctatgcaggcttttttttggttccatatgaagtttaaagtagttttttccaattatgtgaagaaagtcaatggtagcttgatggggatagcattgaatctatattctactttgggcagtatggccactttcatgctattgattcttcctatccgtgagaagaatgtttttccatttgtttgtgtcttctcttatttccttgagcagtgttttgtagttctccttgaagaggtccttcacatcccttgtaagttgtattcctaggtatgttattctcttagtagcagttgtgaatgggagttcactcatagtttggctctctgtttgtctgttattggtgtatgggaatgcttatgatttttgcacattgattttgtatcctgagactttgctgaagttgcttatctgcttaaggagatttggggccgagatgatacaataatgtcatctgcaaacagagacaatttgacttcctcttttcctatttgaataccctttatttctttctcttgtttgattgccctggccaaaacttccaatactatgttgaataggaatggtgagagagggcatccttgtcttgtgccagttttcaaagggaatgcttccagtttttgcccattcaatatgatattggctgtgggtttgtcataaatagttcttattattttgatatacgttctattgatacctagtttattgagagtttttagcatgaagggtgttgaattttgtcaaaggccttttctgcatctgttgagataattgtgtggtttttgtcattggttctgtttatgtggtagattacgtctattgattttcatatgttgaaccagccttgtgtcctaggtataaagccaacttgattgtggtgggtaagtttttgatgtgctgctgggttcagtttgccagtattttattgaggatttttgcatcgatgttcatcagggatattggcctgaaattttctttttttgttgtgtctctgccaagttttggtatcaggatgatgctgtcctcataaaacgagttcgggaggagtccctctttttctattgtttggaatagtttcagaaggaatggtaccagctcctctttatacctctggtagaattcgtctgtgaatccatctaatcctgtactttttttggttggtaggctattaattactgcctcaatttcagaactttttattggtctattcagggatttgacatcttcctagtttagtcttgggagggtgtatgtgtccaggaacttatccatttcttctagattttctagtttatttgtgtagaagtgtttatagtattctctgatggtagtttgtatttctatgggatcggtggtgatatcccctttatcattttgtattgcatctatttgattcttctctcttctttattagtctggctagtggtctatctatttttttgatcttttcaaaaaaacagctcctggattcattgatttttttggagggtttttgtgtctctatttccttcagttctgctctgatcttagttatttcttgtcttctgctagcttttgaatttgtttgctcttgcttctctagttcttttaattttgatgttagggtgttgattttagatctttcctgctttctcttgtgggcatttagtgctataaatttccctctacatactgctttgaatgtgtcccagagattctggtatgttgtgtctttgttctcattggtttcaaagaacatcttcatttctgccttcatttcgttacgtacccagtagtcattcaggagaaggttgttcagtttccatgtagttgtgcagttctgagtgtgtttcttaatcctgagttctaatttgattgcactgtggtctgagagactgtttgttatgatttctgttcttttgcatttgctgaggagtgttttacttccaattatgtggtcaattttagaataagtgcaatgaggtgctgagaagaatgtatattccattgatttggggtggagagttctgtagatatctattaggtccacttggtctagagctgagttcacgtcctgaatatccttgttaattttctgtctcattgatctgtctaatattgacagtggggtgttaaagtctcctgctattattgtgtgggagtctaagtctctttgtgggtctctgagaacttgttttaaagtctgttttatcagagattaggattgcaacttctgcctttttttttttttttgatttccatttgcttggtagatcttcctccatccctttattttgagtctatgtgtgtctctgcatgtgagataggtctccttaatacagtacactgatgggtcttgactctttatccaatttgccagtctatgtcttctaattgggacatttagcccatttacatttaaggttaatattattatgtgtgaatctgattctgtcattatgatgctagctggtttttttgcccattatttgatgcagtttctttatagtgtcaatggtctttacaatttggtatgtttttgcagtcttgtcacttatttttaacatggcactggaattcctagccacagcaactaggtaaggacaagaaataaaaatcattcaaaccagaaaggaagaagaaaaattatctccatttccagaagacatgatcatacacatagaaagccctaaacctaaactgaaatgacttaacaaaaataaactattagaactaataagtaaattcaataaaatacaagatacaaaatcaatacaccaaattaaaatcacatttttatacacaaagaacattccaaaagctcaggtaacaaaagcaaaaataaacaagtggagctacatcaaactaaaaagttctttcacagcaaaggaaaaaagaatcaacgaaatgaaaaagcctgtggattgagaggaaatatttgtaatcatatgttctataaggagttgataactaaaatatataaggaactcctacaaatcaacagcaaaaaaccctgatttaaaaaataggtaatggaactgggtcgatatttttccaaagacatactcatggctaaaagtatgtgaaatgatgttcaacattactaataatcaggaaatgaaaatcaaaaccaaaataagataccacctcacacctgttaggatgactattatcagtaagtcaaaagataaaagctgttggtgaagatgtggagaaattggagacctgatacactgttggtgggaatatgaactagtaaagtcattatggaaaacattacgaaagtttctcaaaaaattaaaaacagaacaaccaaccatatgatacagcaatcccactcctgtgtatgtaacagaaggaaatgaaatcaaagagatatctgcaccccatatttattgctgcatgatttataataggcaataaatggaaacagcctaagtccattgatggtccattgacaatggagaaagaaaatgtcatatgtatagcattattatgtcctctggacaaatactagccccaaactctccagttctcaccagtgaccacatatacttgatgtctctcagtgacattaaaatgtcacatatacccattcggatagtcatgccctcaggtgttgccatgccctcatctagagctctgcacttggtgttttcaggcatggttggtagatttcatgtgtgaaaagataaggtgaacgtttgttgatgagaggatggtcaaagcctcctgaatcccactggttccccaacacgtgtcttttccatccggggcccatgcaccaaaacctcaaataccagaaagccagtgttctggttctagaacaagtctcacagaaataggttgtcctcatttaggcctcattttatctgtcagaagtttaacctttaaatttacactgcccaagttggcaaatatcccatggctgacttactggcttctgctatttctcatttaaaattagaaatttctggtcatcttcagtaactgtttctacatatttaactaattatcagtttttcttcacccaaatgttaattatttacctcacattttacatttgctttgaaagagatgacacatatcagtaccatccttttaggaatggctttaagctatcactaagttgtgtattttaacttaccttttttcttagaggtagcccaaatgtcctgcagaatcactaccacttatcaacatgtaatattacccttgcacaaaaatctcacactcagacccgtgtcaattgttaattattgagagtcaaaaatcacatgagataagtttctcttaggtgatcagtttccaaatatgcctccacataaacaggtggcatcttccctatactctccataatctgttttataatgctggctccacaactttttctccatgactggaaaatcagttctctgttctcataggttgtggtcaagcctgcattcctctgccatccgaaaataaacccactactgagatcacactcgtgtcacatggtggcatcactcaaattaagccctagtggaatggtcataaagtaagtattccctaatacatactcaggaaaggggactgggagaaccttatgacaaagctaacattggtgcagtaaaatgacttcaggatgagaggcacttttccatttgagttcatcagactaccaataatcttggctaaaagactctgtatcagccagcattcaaaatatttgttcatggtgcattataacacagcataacttgagaaataactttaaaaaatacttagcttagtgcttagtggtcatagtttataatatgtacttgtgccaggggaataacattttcatgtctcctgaatgtaagtttcctatttaacagatttatttttatctaatgaatttaaaataccagcatgagtattttactaagagaggggattagataacatcccagtgtctgagacaggggcatggatacttcattatgaaatattcaaagaattcccaggagaaactttttagtgatgacaagtgcagcagtttatgctattcactacataagagaggaggccttcatcattttttctgtgccccatagtgcttctaatatgaattttacaaaagcacacccttgataaaaattatttcaaccatcactaataaaataaagttaaaactctttggcatgtgcctttaaaaaactttctatatttgcaccaaaataccttagcagacttatctctcaccctactcaactgaggtttattccattctcctttacctgacacccacgtcagcacagaactctctgttctttactaagtcattgatgtattcttccctgagggtctgggtcataacttatttttcggtgactgctctgtcctccttacagccactgacgtttggtgttttcttgtcctaaattgacagtgattctgggttgttcaccctggaacctatgggaagaatgttgttgtcattacatcaggaagagaaggcagcccgttgactcagtagtgctgctctgggcagggttgggagctgagcaatagacttttcattatttccaggtgtggcactcctttcagaagcattatatctctggcctctaaatattccacgctggggaaactggatgcattctaatcatgaaggagtttagtaacaactccccaaggtgaaagcctcccagtcttgtccttctgttctaattgaatttccctggttccatggggttgatgctgcgtttctaattttttatgtttcctttcatgcttttcaatcctatttgaaaggtgttagggcaaagtttaagtcaaggtaccaagaaggtgagagcagtgaggagtaagtctgcttccccacccttttccctctctttgcccaacctcctgaatattctaaactactttctcatctcctaagccaattataggaaaggaacaagggctgcctcagagatactaggggtccttgtttttggtggcctaatgttccgcatttggaaacctctaacacttgggtttttaatcccagaattagagcagtagaacatgaagaaagagcaaggagggtttgggcttagcaagtgagagcaagaataggatttttttagagcactcccaaaacaacattgctgccctaagtttgtttttgtactgttttcaaagtagataggattgacttgtatttaattcaatttctaagataagcatgaacaatctgactcctcatataaaccaaggaaggctactacaattctgtgatgtttgtgagggatgcaggtgggcaacatgattcaggttggtgatcagctcctggctgaaacttctggatagcctcttcaacctccagcccatgtcattctggaggataaacccacctttgccattgccaaggtcagtggcttttagtgaaaccaggttcttgtcaatgtccagtaggccttttgcaatatttaaaatttcgtagtcactactcactaagcaaactctgttcagagaggtaaatgtctagttctggtttatggattatgtagagtacacagagaactttataacttgagctgtgcaaaattttgcaatattaactaacttttccttccatatttcttcatacttctctggatttgcactacaaaatcagtcagtcattcagccagccattcactgatttagggaaagcagaaaagataggtacctccattctccctcacatgaggaggttgtctatgtgtcaatgaaggctgaatacggtccttctcttcccacaatcccattctatgtactcaaagattgtttctctgacagtagagattagataaccttttcccgggagagactgagacagacagaattttttagatcgtgtattgtttctaaattaatctgtgttctgcaaaaagcaatgaaaaatatgttaaatcccttttgagattaaattcctcctctcaatagaatggtgattgagatttgtaaaactagttatactagctgggctatgacatagtaactggctcatgacatgtacttacagtgtaagcaactataaaattgtacaaaattcattaggagaccgtttgggagcattgtaaaacaggcagtgcagaattgtgatctttgagagaaggaaatcccatgagataaaccaatgttttctacaggatacaatgtgcctgggggtatgttccaggctgtggcacaaggagatggagtccaaacaaagtgcaaggacttcgctgagctggagagacagtttgtggctactgaagcatttgaagttgcttgtcatatctggagagaaggcagttctggtcaagggtttagggcaagagtccaagaaacctatgacagagcaagtgatgtggggctaagcacagagaccttgctgaacattgtggacattcaattcagaccacaactaggccaggcattaggagtaaggacatatttcagagtaaatactttgccctagaactaagttcaaaactgatgtataaccatcctaacaaagaataaaagcaagcttggcaggaccaaaaggcccaatagtaattcaactacctgccacaacaaaactgagcaacctttctggaagatgttaaagtccaaatttcaaacaatgcatcattcacaatgtactgcacacaaaaacgtttctagacatatcaagaagtgtgaaccagaatcaacaaaagcagcaagtaatagaaatgatctcaagatatctaaatggtaggaattagaagaaaagttgaagaaaaaacatgttcacagttctcctatacatatatgccctcaccaacacaggtaccaccactgatccctgtgaatcaaagagacttgtttaataacttcttcaaggtcacacatcccgtggtggagtcaggatttgaacccagagaatttttcccactgcactcgttttagtgattatttttgatgcacaaatgtcttccatacttagtagctttgaagatagtttcctcttttttgcatggtataaaatgataatatataacaattatattaaatcagatatcttacatgttaattttttttttttgagatggagtttcactcttattgtccatgctggagtgcagtggtgcgatcttggctcactgcaacctccacctcccaggttcaagcaattctcctgcctcagccttccaagtagctggtattacaggcgcccgccaccaagcccggctaatttttgtacttctagtagagacgaggtttcaccatgttgaccaggctggtctcaaactccggacctcaggtgatccgcctgcctcggcgtcccaaagtgcagggattacaggtgtgaaccaccatgcccggcccatgttaatttttaatatgatcctagagaagatagtgaaggaaaaagagacagagaaagaatggacatgtggcttatggcccccctccccactcccagtgttgtccctgtgcctctacttctcatagggccttcacatgggcctggaatggagatgctgaatttaaactcttgcctggtaaatgagggggcttttaggctttctggtgtgaagaatattggcttcaaatggttggcatgatatggaatagcttggtactgtggtccacacatcaacccatgtgtgtacttagaagctctgttttatatgttatatggaaacagctttctaatatagagttggcaagatgaagccttaccagctggccagctattgtgtgagaaacagagtttacaccaggctcatccatcttgcaacacatcaccttcattcccagcaaaattctgctcttccaagtgccagactgtgactcagcagtacctaaaatgtcatgtggtaatgaaacttgaaaatcaagagccttttcaaaatatcaaaatgcaatattccctgcaattaatgtccttttgggtgatctctttgaagaatataatgcaaaccgtaatccttcaaagggaatttacaaggctaactacctcctgaactcatcttaaaggaaatggaagggaaatacggcaggggaaccataagaatcactagaccagcctcgccagtctgtgacatacctacatcttcccccttttcaataacaagccctcgttgcaagcatcttcctggcatctgagttactatgatgaagggaggagcaatgacctgagaagtaatggtcactagtaacatgaacaatgacattcatggtagctaaaatgtattgatcactcgctatttgccaggtatcctactactactttatagggactacctcatttaattctctcaaacaccccttgagtttggtcattatagaaatttcacagaagattttggaattgagaaagcaaaagtaattctcctattgtcacatggccagaagtgatggacctaggatttggaccaggatctgtgtctaacacccttactctaaatgattatattggtgtttctagattttcacgtgtttttctagttccctcaggtgtatatttaggttgtttatttcatatttttcttctttttaaaatgtaggtatatatcactatacattttcctcttaggattgctattgtatttatctattataaactataaaaaaagcaggtttagagaacataatgggatgcaagacattggagattgagaggaggaagtggggataacccatgtagacaatttataagaaaaattttgctgtgaagggaagcaggtatatagctggtagagaagtgtcatcagaagaaggtatttgtttaaaatggaggataatggagcataagtgtatgccgatggtaataaccactggaaaaggagaatttgaagatgcagagaaacagtggtcatctgcaggaattaaagctgtgcaagggtgagaggtaaagattagatcaactggagatgttggatttgttaaaatggtgacgcaccagccccaactttcatactcagtgataacctgcatgccaataacctacatcccagggatggtcaaattgagaatgagggattggcaagacagagatgtccagagaatgaggaaatgagaggcttgaagaccctaagactcagactgactactagaggctaatctgtactgacaaattcatattttgagaaatgtattggtttgggattattgtgtgccactcatagttccttcaagtttgtgtgtgtttatatgttcacagggaggtggaaatgtgggaagatcccattgttgattaaaaaagaaaaccccacagtaaagcagattaatggaggggactatctcctttccagggagagaaaagggcagtgttcaaagcaggaagaaaagccatgaacaggaattcacccgaaatggaatgtcatcagaagaccttatcttttccatgggaggcaggggatgggcaattctttttggactctaggagcatggatacatagccattgctcgccagtaatttgttccactataatttcatgtagtcactattgacctttcattgaagtctgtaactggcagagtctacagtcctgtgagtggtgcttttggagagttaagaagcagagcagtcaagagaagcattgctttcttggcattgccattccccattggtccttctccaagggaaactggtcctggtcatccagagaccagcagccaagtggatctgggatcccctgagagggatgtgaaacacagagaaatcactggcaggtggatactcaggagtgcgtatgagacaacccccttgtcccaaagcagactggatgtcacacaacatccctggaggtcagggagagcagcacacctccatgtgattccttctggtgtagggcatgactatggatgtgggttgctccattgcagtgaagacaaggttacatgggtatttcagacagaggagttccaggacataagaaatggtaggcagctgggccccaggaggggagagtgcagctggacagactttccaagactcgttggaataaggggaaagaagggaggggaaggtgggggcctatgaccagcttttttgttgtcttttttcacaaatttatggtgtgagggtgggggtggagcaagttggcagagtagaaggatccaccaattgtccctgcaacaagaacaccaatttaacaactatctacacagaaaaaagcatttttataggaacaaaaatcagctgaacactcacagtacctggtttcaaatttatattgctgaaagaggcatggaagaggtagtaaaaacagtcgtgaatcaccgacaccacctctctttcacaccccagcagcagcagcattgtgtgaagagcgtttctgtgctctgtggaaaggaagagccagcaattgtgaggcaccagactcaatgctgccctttatacagcagaaagcaaaatgggatcaaacttagcagatgtctgcccatggcaagagcatttaaaccagccttaatcagatgagaatcaccagtcccagcggtcagagcttgagttccagcaaatctcgcccctgtgggctaaagttctctgggatgctaaataatatgaaatgcagtctaggccacaaggactacaattcctaggcaagttctactgctgaacagggcccagagccagaagactagggggacacacaacctactgagacaacaaccaggatcctaagggagttctggcatcaccccttccctcaccccaggctgcagagcgtgtagctccaaaagaggtcccttcctaataactgaggagagaagagggaagagtgaggaggagtttctcttgcatcttggataccagcttagccacagcaggataaggcgacaggcagagtcataaatctacctttctaggacctagctcatggacaacatttctagacacaccctggacaaggagggaacataataccttgaagggaagcactcagtcttgtcaggattcatcacctgctaactgaagatcccttaggtcctgaataaccagcaatgatatccaggtactacatcaaggaccttggacaatactctaagacttgcgggcttcaggttagactcagaacattctcagctttggtggctgcagggcaagacccctgcttgagaaaaagcagagggagaagtaacaaataacataaaatggatctccaatatgcctggcagcagacatttaagtggaaaccttacaggccaggaggcagtagcatcacatatttaaagtgatgacctagatgacaggttgatgggtgcagcaaaccaccatggcacatgtatgcctatgtaacaaacgtgcacattctgcacacgtatcccagaactgaaagtaaaatttaaaaaaaaaataaagtgctgaaggaaaaaaccttttaccccagaatagcatttctggtgaaaatatccttgaaacataaggagaaatactttctcagataaacaaaagctgagggatttcatcaacactatacctgtcctacaagaaatgctaaaggaagtactccaatcagaaagaaaaggatattgatgagcagtcagaaatcatctaaaggtacaaaactcactggtaatagtaagtacacagaaaaacatagaatagtataacactgtaactgtagtgtgtaaagtactcttattttaagaaatattaaatagaaaaccaattaaaaataataactacaacaactgttcaagacatagacaatacaaaaatatataaatagtaacaaaaaatattaaaaagctgggggacaaagttaaggcatacagaatttattacctttttgcttgtttgtatgtttatttgttaaagaaaacagagttgttattagcttaatataatgcactataagatagtatttgcaagcctcatgttaacctcaaactaaaaaaatacgataaatacacaaaaaataaaaagtaagaaactaaatcatatcaccagagaaaatcaccttcactaaaaggaagacaggaagaaaagaaaaatggaagagaagactacaaacaatcagaaaacaaataacaaaatggcaggaataaattcatactatcaataataatattgaatgtaaatagactaaactttccaaactttccaactgaaagacagagtagctgaaaggatgaaaaaacaatatccaaggatctgtggcctacaagaaacacacttcacctataaatatacacatagactgaaaataaaatgatggaacaagacagtccatgccaatgaaaatcaaaagaaacaggagtagctatactcatataagataaaatagattttaagatgaaaattatcagaagagacaaagtcattgtattatgatgaatggatcaattcagcaagagtatataacaattttaaatacatatgcacctaacactggagcactcagatatataaagcaaatattattagagctaaagagagagataagaaacaatacaataatagttggagactttaacaccccactttcaatattggacatattttcttttctttctttctttttttttttttttctgagacgaagtttcgctcttgttgcccaggctgcagtgcagtggttcaatcttggctcactgcaacctccgcctctcaggttcaagtgattctcctgcttcagcctcccaggtagctgggattgcaggcatcagggaggcaggagatgggtggttctttttggactcccggggcaatgatatttagccattgctcactagtggtttgttccactatcatttcatatagaaactattgacttttcattgaagtctgtaagcggcatagagtctacagtcttgtaagtggtgttttttgaggacttaagagcaaagcagtcaagcgaagcattaccttcctcacataagcatttcccattggcccttctctaagggaaactggtactagtcatccagacagagaccagcacccaagtgggtctgggatcccctgagaggggtgtgaaacacagaggagtcactggcaggtgggtaccaaggagagcatatgagacaaacccccagaccaaaaggagactgggcgtcgcctactgtccatggaggtcaggaagatgggcagaccttcatgtggttccttctggtggagggcatggctatgggtgtgggttgctccactgcagtgaagatgagggatatggtttggacctgtgtctctgccaaaatctcatgtccagttgtaatccccagtgttggaggttgggcctgataggaggtgattggatgatgggggtggtttctaatggtttagcatcatttccctagtgctgttatcaggatagagctctcatgagagctggttgtttaacagtgtgtagcatctcctcctgactctcttctttctgccccacccatgtgaagttctccctccccctgtgaagtgctccttcttcctttgccttccgctaggattgcaagtttcctgaggccttgccagaagccgagcagatgccaaaatcaggcttcctgtacagcttgcagaactgtgagccaattaaaccttttttctttataaattacccagtctcaggtatttctttacagcaatgcaagaaaggaatagtacaatgaagttacttgggtattttgggccgagagtttccaggacatgggaaatggcagctgggtcccaggaaaggagagtgcagctggacaaagggacttcagagactcgctggaataaatggaaggaagggagttgaagttgggggcctatgcccagcttttgtgtgttttttcttcacaaatttatggtgtggaatgtgtcatgtcctgcctggaaccctatttgtccagcctctgatacagggagccaatacaaaggagatagctactcaggaaaaagggacagggaagaggcccctcattagtttggctgcttccccaaacaggagactgtcagaaacttccctcctttgggtctccccccaggccctggtggaatgggagtgtggcaggaagtgggagcccatgatctgggccgaggtctcccaggccacagaggagaaaagggagggagtcagttctgttctgtgcgatctggcaggaagggtcagggaacttttctggggcagcatttctgaaatcgggctggaactatctgacataaaatggggatgactgaaaacctcccatattatgatagcggctagtgggtggggaacagggcaagtggattgggatagcaagaatcctagattccacgggcatgatttggaggtacaacacattgttggtaagatggtggctaagggacaaggaagcctggatgtaaacgcttaagattggtattggatccctctgcctttccgttctcctccacccagcagtgaggggaggtcagggcagaactaaagtgaatgttcttttcatttgctgaataggggcttgtgtacctcacaggaagacagaatgtgcacatttctctgtgtttctctttgtctcattcttagtcctgagaccattagtcctagttaccatgggaaccaaagctgagtgtctgacgcattcactggactctgggagaaaattcgagttggtccctgatttcagtaatcatccgtttaccaccttcactctttttgcgatatttaattgtggtaaaactattataataccaaatgcttccgatctacgttaatatttcacttgcatttcttatagtttgtttagaattttaattcattaatatcacacgctatcttcattgtcgtgtttagaaggcatagtgttttcctttgaacaaaatagtttttcatcaataagtatattttcaaaggaaacttaatatcactaccataagtggaaatccaacatgacttgtcataaatagaaagttactgtaaaaaacaaacgtgaggcaaaatgtaccatttaggaaaaattatttaatgtgttttaaaattgtcaatgtttcattcaaatgatgcacctgacctcattttgtgtaccatatgggtataattttggtaaattttatcaatgtgaggcagtcttctgtagcccaattccctctggatgtgtggacaacgtttaattgctgcacctacaaaactgggaataacggtgatcatagcatggtactgacttcccctgtgggggacctgaccggatgacgagatggccttccccaggcatccttggagtcattataccttttaaaatgatgagaaccggcttgtgaatgtttcccttgccagttcagggtacatggattcattagtgatctggacagaggcattgttcatttcctctgtagctctcaaaacttgcacactatttggggaagacagagctctcaaaaaatgtgtgtcaaataagcttccttctttgcaaattctgttccttcttcccagaatgtcattgccacagctttgatggttgataacctgcaattcatcgcttaaacttggagcaagtgctcctgactccctcaggaagttgtttcttccctcctctttgttcctgtaagaaaggtaatattcactatgataagtatcattgtctatgagccttatctctcccaccggactctgaacttctcaatggcagtgactaattctcgtccatcttttcgaaggctcttcagcttatatagcacctttcgttgtattgaataatgtcatgtatgggtcccatttttcaaaccagattgggagttcccgtggtaagaggaagcctgatcttccattctgtatgctgtgtgattctacagccatcagtcctgctcctagtgccccagcaagcctttccttggctatgaagattgccaaaatactgaagcctcagtgaagcctcttcgttcccccaggtttcattttctggactcagggattttattacccactgtaaagactaaatatgcttttcactgtgtggaagaaagtatagaagttcaacggcacattgtttcttcatcatcctatgttctctgaaaaatatttgggttcggaaatattttgtgcgcctcttatccaatccactgttggagaaagagaaatttcatctaaagttctgcaaactccttcgaattccttgtggtagatgtaaatggggagggagagaggatgggcaggaaggtgaagggaggacctgggagataaggggtgcacaggatgatatctgaccccactatccatccactcctcattctactcctagcaggtgcctccgccccaccaccacctggagaagactgcttagagaaaagaagaccttccagactcagcccattcacattcctcttagtctttgaggttcatgaaagttaggtaacttgctcaaattcactgaagtcattctatgagaccaatattacccagaaaccaaaggcagaagaggacatcccaagaagagcatactacagaacaatatcttttataaatgtagaagaaaatgccctcaacaaaaccaaaaggagagattggcagaacagatttgtttaaatgctccagttacatgctatcttgaagaggtgtgctttactttcaaagacataaattgcttaaaataaaagcgtggaaaagtatagtgtggaaacaatcatgaaaagagagttggagtggctctactaatattctctgagacaaaaatatactttaagacaacaattcgatttagatacagagaaggacgttttatcacggtagagtgctcaatccatcaagaagatataaagatttttataaaaatatatagacacatagcaatagtgccccacaatacacgaagcaaaaatggacacaactgaagggagaaagatgcacacaagatcccagccttgtaggatgtggctaaattagctcttagatgcaaatgtatagctataaacacctatattgaaaaaagagtagtgctctcaaaaaattcttctaaatttttatgttaagacacaggagcaagaaaattaaactaaccccaaacaggcagaaggaaggaaataaggactgttagagtgatataaataaaaagaatataggaaataatagagaaaattaaccaaaccaaaagttggttcattaacaaagatcaacgaaattgacatgcttttgctagactaagaaagaatagaaaagatgcatattacaaaaatcaaaactagaatataggatattaatacaatcttacagaaataaaaaggttatgggaaatactgtgaacaacagcatggcaacaaattagataatcttgtgacaaggacaaatgtccagaaacacacaaattactgaaactgcctaaaggagaagtagaagatttgaattgatttacaacaagtaaagggattgaattactaacaaatatattcccccaaagaaaagtccagggttaactggtggaattctaccaaatatttaaaggacacttaacaccaaagcttcacaagattgctcaagaacagaagggcgcccttcccagctagtttttcgagcccaactttaaccaaactccaaaattagacaaggcatcagaaggaaataactaacctaattacagatgcatatctgttatgtatacacaaatctcctccacaaattacacacatacctaatccagcaacacacacacgtgcacacacacacacacacacacacacacagattttacacaaagaccaagtggaacttgctccaggaatgtaaagttggttcaacgtacaaaaatcaatcaatataatataccacactaaccaaataaaaaccccatattatcgtttccgtagacacagaaaaaacttgtgacagatccaaaaccgtttcacaattaaaaaaatatgaagaaactggagaaaaaaggtgcttctgcaactcagtagactctaccaaaaactcacaactgccatcatgattaatggtgaaaggctgaaaactttcaccctcaacaagcaacaatgtgtgctctcaccatttctatttaacattgtacaggagcttctagctaatgcatttaggcaagaaaaagagatagaagacctccagacttgaaaggaataagtaaaactctctctgctcacagatgacattatcttgtacatagaaaacactaaagaagccggaaaagaaaatactatcaggacgagtcattgaatttattccatataatatctacatcaatgtaaaacatacaattttatgtctttgtactaccaatgaataatccaataaaggacactttaaaaacaattccacttatcatagcatccaaagaaacacaatagttagaaataaattccacaaaagaagtgtaagacttgtacgcagaacactacaaaaccttattgaaagaaattaaagaagacctaaagaaatgtgaaggtgtcccttacacatggacggggaagactgtgtatcattaaaatagtaacagtccacaagtggatctatagatacaacatactcaccgtttcaaatcccaccaggatcttcttgccataattgacaatctgattctgacattcccttggcaacgcaagggacccagaaaagccaaaacaatcttgaaaaagagcaatgatggaggactcacacgtctctatttcaaaacttactgcaaagctacagtaatcaatgtgttgtggtactggcataaatttaggcatatatatatcagtgtcataaaaatgcaaattttagaaataaacctcttcttttaagttcagttgattttccacaagtgtatcaaggcaactcaaagtgagaaagaatagcattttccacaaacggtgctgggacaaatggttatgcccatggagaagaatgaagtggacccaccatctcatgccatgcctgaaaattaattcaaaatgaatgatagacataaacctaaggggaaaaaaactatgtaacttttggaaaaaaactttggggataaccttcatgaccttgaaattggaattggctttgtagatatggtacccatatcacgggtgaaaaacatgaaacacagaggaattgtacttcattaaaattaaatacttttgtgcttcaaagcccaccatcaaggacagggaagacaacttatgagatgattgaaaagattggaaaatcatatatctcatatttgactctatttgcaatatctactaaacacttacgactgcctaataaaaaagacacacagcccaaataaaagtgggcaaagcattgcaatagacatttctctaaagaacatgtacaaatggctaataagctcaagaaaagatgctcagtgtcattagtcattagggaagtgcaagtcaaatccacgttgtgataccacttcccactcactaagatggctgaaatcaaacagatagacaataacaaatgttggcaaggttgtggaggaactggaatcttaagacatttctcatgggattgtaagatggcccaatcactttgggagagggtgcagcagttcctccaaaagtaagagttcctttatgacccagcaagtccactccaggtgttcacccaagagatttcaaaaaataactcaggtaaaatcctgtacaagagtgtccataacagcctcctccatagtagccaaaaagtgaaagaatctaaaagtccatccacagttgaatgagtaaccaatatgtagtatcattatatggtagttaatggaatgtacgagccacaacattgattaatctggaaaacatagtgcttactgaaagaagccggtccaaaaggtcacgcattgtatgatctgatttataggaaacattcactacatgcaaaatcagagagccagaagatagatcagagggtaccagtggtttgaagaagaggggagattaggtcacttaaatacatacagcgtgttttttgaataaaaaagttcttaaattacatggttgtgatagttgcacaacttttccgttttttaaattttattttattgtgctaagaacacgtaacatgagatccgccctcactaaaattttaagtgcaaaataccatattcttaaccataggcacagggttgtacaggagatctcaagaatgtattcacctggcacaacggaaactttatacccatagaatagcaactccctgtttccccctccctccaggttcaagcagccgacactgcactctggtttttaaatttgactattttagatagctgaaatatttagaacccacattatttgggtgtgatggcaggaattccttcttcatggaagtggaataatgtcccattttatgtgtataccacatttttaatatccattcatctgtcgatgaacatttaggttgtttccacattgtttttaaattttgactgttagatgtaatgcttcaatagaggtgggagtgcatatatcccttcgaggtccagatttcaattcttttggatatatacccaaaagtgggattgccagatcacatggtcgttctattttcaattttttgaggaaccactacggtgtattccatagtggctgcaccgctttatgtgcctactccagtgtgcccgtgttggaatttttacacatcttctccaaaacaacacttgttatcttttctttctttctttctttctttcttttctttccttctttctttctttctttctttctttctttctttctttctttctttctttctttttctttcttctttctttctctttcttttttctttctctttctttcttctttctttcttttttgttttgataatagctatcgttcaaagtgtgaggtgatagctcattgtggtttggatttgcatttctctgctgagtagtgacgttgagcactttttcatatactgttgggcatgtgcatgtcctctttgaagaaatgtctattcaagtcttttgcccattctttagtcagtttgttgtcttcttttttggtattgagttgtaggagttccttgtatagcttggatattaatcccttatcatatatatccttttcaaatatcttttcctgtaaatctcctagaagagaacataggtgaaaagttccatggcatttgacttggaaattatctcttgaatatgacaaaaagcacaagcaacaaaaagccacgttagactggtgagactaagtcgaaccaaaaacctatggtgaacccaccggggcctgttgtgggtagggggaggggggaggggggagggatagcattaggagatatacctaatgcaaaagacgagttaatgggtgcagcacaccaacaggtaacaaacctgcacgttttgcacatgtacgttagaacttaaagtataataaatatatatatatatatatatatataaaaaataaaataaaatgaaagcaaaaaccaaaaacgaaaacaaaaacctatggtgaaccaaatgaaacaatcaacacggtgaaaaggccacctacggaatgggagttgctcaacttttggaatatactaacaaccactgcacggtacactttaaaagggtgagctttgtggtatctgaattatatctcaataaagctgtttcttttaatgaaggaggaaagaatctctgaaggaattcaaaatgttcataacttattcctaagttaacatacatgctagtatattaggatacaagttggagggatatttttgaattattacaaaacgaaacctatacgaagacttccataaggctgaaaaattaaatgtggtaggaggcttccaaagcggcctctctggcagagtagcaaggttgcaagaacaatgtcaaaacaaagctatttctcaggcatgacctttgtgattgtttctatgtctcagactcccgtggatcctacctgctttccaattctggttatgcagccctcttattgacttcgtgtgcaacctgatattcttgcatcaggtttgtttgtttgtttttttttttttttttggttgagcaatcgtgagtgtttttctgttgttgctaaccaaacattctgatggacacaggaggtggcagatgtaggtgttatttacatctgtaaagtgaaaggaaatttcttcgagaaaaaaatgtagaaaaggaggaaacaaggccacaatctggagcatatcaaaaagtagaggagtttacaagaagaggagccaggaaacaactcaaagaataggatctatcctggaaggaagatcaccagaagaagatggtttcatggaatccacaagatctcaagagaccgatagtggccagcacgttcaatgctactaagagggcaagccaggtcagagggatgataattggatttgacatcatgtaagttactaaagagcatgaaaaagaaaaaaagcatattggaggacagaaggccatgcaagacatcggaggtggagatgaggaagtggtgacaacctgttcagacaacttaccagaaaagttttgctgtgaaaggcagcaggtatgtgggagaacagctggtagggaagtgtcgccaagggaaggtatttgtttaaaatggaggacagtggagcgtaattgtatgctgaggggaatagccactggagcagaagaatttgaagatgcagagaaacagtggacatctgcaggaattcaaactgtgagaaacagtgaggggtaaagatggggtcaaccagagaggctggctttgttaaaaatatgagccaccagccccatgcttcatgctctcagttaaagccatgctgataacctccatccccggggatggccaaattgagaatgagggattggcagggcagagatgtccagaggatgaggaaatgaagtttgaagtccataggatccaggctgagtaacgaaggttaatgtaaactgacaaattcaaattttgagaaatgtatcggtcagagatatttttaatttttttaaatttaattttattttttttctgcagttggggtctcgctgtgatgcccaagctggtcttgaactcctgccttcaaagtgcagcctcccaaagctctgtgcagtggtgctgtcataactcactgcagcctcaaactcctgggctcaagtgatcctcctgcatgagtctcccgagtagctgggaccacagatgcgtgccaccatataaggctaattttttctatttttataattttagagatgaggtctcgctacattgaccaggctcgtgtccaactcctggcctcaaccaatcctcctgcctcggtgtcttgcatagctggggttataggtgtgagccactgcgcagagctaggtgagggattatgatgtgacactcatagctccttagtgtttggtgattgtctctgggtgttcacatgttcacagggaggtggagacatagacagatcccattactgagagataaagaaatccctacaatgaagcagattaatggagggacttccttctttccagggagagaaaagggcagtgctcaaaacaggaagaaaagccatgaacgggaattcaccggaaatggaatgtcctcagaagaccttatcttttccgtgggaggcaggggatgggtgattctttttggattctagcagcatggatgcttagccatcgctcactagtagtttgttccactataatttcatgtagtcactattgacccttcgctgaagtctgtaactggcatagcgtctacagtcctgtgagtggtgcttttggggatttaaggagcagagcagtcaagcgaagcgttgccttcctggcattgccattccccattggtccttctccaagggaaactggtcgtggtcatccagacagagaccaggagccgagtggatctgagatcccccgagaggggtgtgaaacacaggggagtcactggcaggtgggcactcaggagtgcatatgagacaaaccccctgacccagaggagactggatgtcgcgcaacatccgtggaggtcaggaagatgggcagaacttcatgtggttccttctggcgtagggcatggctgtgggtgtgggttgcacattgcagtgaagacgagtttacttaggtattttggactgaggggttccaggacatgggaaatggagggcagctgggtcccaggagaggagagtgcagctggacaaagggacttctgagactcactggaataaatggaaagaagggagggaaagttgggggcatatgcccagcttttgagttgttgtttatcacaaatttatagtgtgggacgtctcatgtcgggcctggcacgctgtttgtccagcctctggtaaggggagtcaatacacaggaggtggtgggcttctcaggaagaggggcaggcaagaggcctctcattagtttggctgcttccagaagtgggagactatcagaaacctccctcgtctgagtctccccaaggccctggcggaacaggagtgtggcaggaagggggagccctaggaacttgtcccatggtctgggcagaggtctcccaggccacagaggagaagagggaggaggtgtgtcctgtgtgactctggcaggaaggatcagggagccctcctgagacagcgcttctgaaattgggctggctggaactttctgtcagaaaataggaatgactgaaaaaactcccctactgtgatagaggctagagggtggtaaagaggaaggtgagttggggtagcaggaatcctaggttccacaggcatggtttgcaggtacaatacattgttggtaacatgatggctcggggacaaagaagcctgtctccaaaccgtgcaggtgcattgagaggatgtagaaattctggattcatgtcaggcccgtctgcgtttctgccctcctccacccagcattgaggggagggcagggtagaactaaagcgaatgttcttttcaatccctgaataggggcttgcgtacctcagaggaagacagaacacgcacatttctctgcgtttctctttgtctcatctttagtctctaggccattagcccctgttgccatgggaactgaagctgagtgtctgatgcattcattgggctgtgggagaaaagcagagttggtccttgaaataaaggcccctgggagaggggattctagcaaggcagtcacattgaaagaattcacaattcccacagatatattgatccttgtgattattagtacacacacacacacacacacacacgcacacatcccacacacccccaccccatacacacacacacacacacacacacacacacacacacaggcttcatcctgaacagatacgatgtacagagcatcgcactggctggcccatagggttcttgtgggagaggccaggcctctgtgaccatgaaaggggttgcaactgatacagtcagggagggatcccaggaaggggagtgattcccttaaatttgcttgttgaaacccgtatctggcaggggaaaggaggatccggtgcagagcttggattcagcagaggtggctgttgatgtgaccagtccccctgtttgggtgggaaggccctgaatgacacatgcagcaaggcaagagtggtcccgtgcaccctttgctctttcttggcttatccagctcctccctctgagatagtcccatggggagccccaggttgacctgggatggggatcccctctttccaggggcagggtagagttctcaaagctggcagttttctcctcctttccctttctccctcgctgccccttcttcttgccccctgctcatcaatcaccctttggtaaaggacctctccccttgttcctttctctttactccctcatccatttcctctacactcctttcctctttcctctctcttcctacctcacttcagcctctgtcatcacctctcatctcccctctctgctctctctcctccatgccttgtctttccctttgtcctccctccgagttcccatatccctcactgccctttctctccctctttcctttctcatgttgtcctcccctggttttcccctcattttgctttttccttctctctatgccgttccctcccctcaccctccccgccctcccctcccctgatactcacccagtgactaatccgcagttccttaagtggtactgggcgtaacgtgggctctatgtgtttagctttcagcctcggagggcagtacatcctaaagtgaatcaccaacttaattattcctctgcaaattaccatcagtgatacgagattcaacgacaaggagctgtgagagcgcacaggaagggagctcatttctggggtgggctcagtgaagaaaatgtcattgatgatagtccttgttctgccatccaccatcctctgcttgcctctttctgtcactgccttcccttttatgttgggggcaactctcctcttctatcttttgcagcagggtgggactcctctcatggtgtcctgccctccacaccccaaggtgtgagttctcatgaagtccaaccggatgcccatttcctgcaacctgagcacccaacagaccaaagagcatgaggggtagtttcaactcgcccggggacccttgttcctgctcccagcttccccagggcacctttggtcatgtacttcactcaccccttctctttctcacgttcacttctcacctctcttccccctccctctttcctggctgcatccttttctcctaaggctttaccccataaagacaaagaaactggctgaggagacaagagaaagaaagtagcagaagatgggaaggaaacaggtgagtgacactgacttagctgattaagagagcttgatcttttttgagggtgtggggggttctcgctctgtcgcccaggctggagttcagtggtatgatcatagctccctgtagcctcgaactgctgagctcaagggatcctccagccacagcctccagagtagctgggagtacatgttaattttttttttatgttttgtttttttacagacggagtctcacttgtgttgccaagagagcttgagcatcaactggcagtgaggatggcaggaaagcaactgacttatcccctctcaccagaccttccaactgtctgcaacactggcattgccacgtatcccggcacgttgttggtaatggtgggggctgtaaattgcacgattgctctagaaagtgtatttacaaatcacttagacgcccagatcccctctcagctcctcgtagcatgacaaatcgctctccccccactctgggagatggcggacaaatgtactctctgcagagcatgaaccagcagatttatgggctttggaacttcaggctcacttcaaggcatacatcccaacccggcgtagggatttcagttgctgtctacagcaatcttcagtccctcacctccgctggagtttggcgtccagattgctggcatcttgccccttctcagagatgcaggagagtcttcctgtgtaatctaaacttccccagagaggagacttagtaatattggcaggcaaagacctctggagtttgcttcattagtaagctcaaaatattttcttatttcaacgttagtttttcttagagccatgggttacttaggaggatgtttcttaatttaccaacatatacgggggtttgtaatgatcttttgttattaatttctagatcccattgtggcattgtggtcagagaatatacaaatcgctgaagaatccattgtttatggacattcctgggatagtattcatttaaatatctctatgtacactgtaatggaatataatacaaaaatggagttgcacgcaaaatgagggtaccactcagtaaatggttccacagggacgtctgatcccctacgatctgggttaagaaatggtgtagtgtattgccggcagctcaaaagcactctcatgccagtcactcttgtcttccacctcagcaaatctaaccactcttgtgacttttaacacttgacgataatcctgcctgtttgtgaacgcattacacatgagtagactcagtacagtacgtattttataatccgggtttctcttggcaacattaggtttttctccttgctattcacttttgtcgtgctgtgtagctgaatttcgtttctttgcattcctgcgcagtgttttgaattgtatgacgatgccacaatttattcatgccttttatttctaatgggctcttcagtagtttccagcgctggagtgttagtgttattattgtggtgcacgttcacaaggatgtcctttggttaacatgcgtatgcatttaaggctgtgcttgcaggactgctttgattactttttcttccttcatggcactgtaagtggtgacagtggatgtatctggtttttttttccccctgatctcagagggaaagctgtcaacatgtcacccgtaagtatcgttgtttttgtaggcttttaaaatatattccaacggaatcaagagacttcccttttgttcgtagttggctaagaggttttatcataagtgcatggtcatttaaaaaaaatcaaacccatgaaatacccttcctgcgtctgtagggaatatcatattttttctccttcatacattacttctgagagatagatttttcaagcgctgaaccgcttcatttctagaatactcttgacttgtttgtgatacgttttcctttttggagatttaactgatttgttttgctaatgctttattcaagatttcttcttctgtgcttatgtaaaagataggcctgtgcatttcatttcttaccatgccctttaaggtttttccctcataaaacgggatgggaagcatttcccgttttttatgttacttggcaagaaggtaagattgatattccttccttcacaaacgttttgtagaattaatcggtggcagcatcagagtccgtaggttcttgtggctgttgctgttgtttccttcagattccgcccgtttagaatttgtaggacaattcagatgtttagtctgttttctgtcattttgttgtattttcttgaaatgtgtaaattatatccaaagtttcacgtttgtgggcataaagttgctcatggttttgaataatgatctctttaatgccttcattgcccatagtgatgtctccttagccactccagacacgggttgcttcatgatttctctcctttttgttcaggcctacacaaggcatgtcttaatcacatcatcttttcaaaaaaccacctctggctgtgttgttttatctttaactgatttgtacttttatcgttatttcatttcttctgctttcttcaggtttaatctgttgttcaacatggttaagaaagatgcaaatgttgtgcctttctttttcatgcaatctagacaattaaaatatatcccataagatttcatcaggttcaaaatactttgcgatttcattggtgatgttttccttgagctatgggttatttagaaaataggaaataaaaaggatgccttttctaaaaataaaatgaagtgaaataaaaaggatgcccttttatttcattttcttgcttaattgccctctgaacttccgggactatgttgagaagaagtagcaaaagcgggcatctctgtcttgctcctgatcttagaggaaaagctttcactctttcgccatcgtgtacagtgttcacaatgagtattttatataggacttttgtgacgttgaggttgtttccttctgtttcaaggagtttgagtgtttttatcacgaagggggttgacttttgtcagatgcttttagtgcatcaattgagccgatcatgtggttttgtccttcattttgttgatgccgtacactaaattagttgattttcattgatcgaaacttccttgcattccacgaataaatcccacgtggtcatgggcctttcatgtgttgttgaactcggtgtgctagacttttgttgaatatgtatgcacaaacattcttttgggaagtgtgtgtgtgtgtgtgtgtgtgtgtgcgcgcgcgtttctggtcctagttcttctctaactgtttagtagaattctccactgaagccatctagtcctgcggttttctctgttgggaggttgatgaatactggttaagtctccttatgagttgtcgagatctgctgagattttttatttcttcaggagtcagtcttggcagcgtgtacgtttctcagaatttatccatttcttctaaagtatcaaatttgttggggtatagttgttcctggtcttctccttataatcttttttatttctgtagtaacaattgtaatgcccctctgtcattctgattttagttatttgacccttctctgtttttttcttaatctgcttaacctatgttgaccttttcagagacaccagctcttagtttcattgttttttttttcctattatttgtctattctccatttcctttatttgtgctctaatctttattacttccttccttctgctaacttcgggtttacgttgttcttcctttgctagttctcgaaacacaaagataggctgttgatttgagatctttcttctttttcactgtaaggatttaccacaataaacttccctcttaacactgctttccctgcatctccttagttgtggtatgtggtgttttcattgtcatgtgtctcaagatactttctaatttccttgtggtctgttctttgacccactggttgttgaagagagtgttgtaatttccacctgtttgtgactttttcaattctccttccggtattgctttctagtttcattccattgtggtcagaaaagataattggtatgatttcaaacttctgaagtttgtgaagatcctaaatgtcaacaaaaaagctaaagcataagacctctggaagagaattcaggataaagccttgaaaaacttgctgtaggcgaaggactcttatagctatgacacagaaagcaatagccatgcaaaaacaccttaagtgaatttcatcaaatttagaaatctggcttttcatcattagcgaaatgaaaaagcaaaccattcattgcggcaatgtttgcaatatatactacccgacaatggaaaagtttgcacgcaaaaaagcactcttataattcagtattaagacgacaaatgataatcaatgtgcaaaccatgtgaatggttcttcacatgcaacacggaacgatatgcaactggtcaagagaagaggctgggccaaggtcactagtggaggcagcggcaaagctgggtcagagatctcaggcaagtcacctcccttctctgagtctgtttcctcaagtgcacagtagtagctcagacgatctttgagggtgtcacgaggtagtgggcaaaacgcccttggcccagggcctgatgacgacaaaaacaaggaggagcagcaggatggatgcccaggaaggaaagcacccaacctgatgtctcaggaggctgggagggcggtggcaggcctcagaaacctagggtggaacctgtcgttcagggaagccgtgaggggtagcgaatcatgcacgatgaagggagatggggagcggtatgtgcacgtgggtgcgagggtgggtgtcaggagagagtgcccagcaggtgggtgtatcacccccaggacactgcaagaccctggatggcaggggaggccgacagcagggcccagtgcacgcaccctggcctcagagggtcccaggttcaagtctgtgctctgccacttcctggctgtgtgacttggggagagcatcttccctctcggagcctcagttggctgagaccatgaaatggccttactgcccccacctctcgggcttggccgagaaacagaaacataggcccagatgagaaattgtacatgaatattcagaacaactttatgcataatgtcaataactggaaacaagtgaatgcacgaatgctcgtccatcgccaggcctggggcaggggtgatcagagggagcaggccaagctgggagaaggctgtgagtgctgtccactgacacagcagggcctcagaaaacacttgctgacatggactgtgggcctttgcagtgcggggtctgcagaaggccccaggccgggggcaggggggaaacctgcctaggtctcctgtttgccatgtgagtgaggtggtggccgtctccagggtggccggtctgacccttctgcaggacgcgcagtccagtccgcccccatttcccaccagggtgctctcacctccctgctctcctcctctcttcccaggtgctctcagcgctgcccctacagggtagggggagtgggtccctggtgaggccccaccgcagcaaggtgatgtgaaagggagagtgtccagcaagcctggaggcctgaggaggccgtgacctggccagcaccccacctctgagggctgcttcctgttcctttccggtggaacttccgtatctcaagtgccctctgcacacagtgttcaaactcactcctgtggcttatggtgactacccccaccctgatccaaggacaggcatgtgcccgctatgtgcacaagggtgtccggggaggttccagccaaatagcattaaatttatgacgccaggggtggtggagtcccaggcatccctcatctcttccacagcccagaccacaaaccaggagacataaagggaaggggactccattgtgtgtgtgtgtgtgtgtgtgttccagtaaaactttggaactggatttctgtcagagtcccagaatgtcagtgtggccaagcatggacccaagcaccagagaagcagaaatcacagcggcagccaacacggagacccacccaaagcctttctgacggacagcttctggggtgtgcaaccaatgcagtctgatgctcaccagggctccccatgtggctccatgctctgctgttgttgttttgaaatccttcatagtttttgacaaggagactcgtgttttcattttccactgggcctcccaaattaggtagcccggtctgggtcaggatctggccgtggcggagatggcagcccctcctggggaaacagaggctggggctgggtgagggggtgggaagcagggagccttccactgctatgttttccctccttatctagggctctgtcctcccaagccctggacattaccggggaactccagaagccctggacactgtccctgcctgccactgagcccttcccaggagaccaaactgtctctgccctcactgtcttgtacctgaagcatgtgcagccctacctcagacccctccagacatcacccagcccttgaacacaccaggacctaggtaggcctggtgttgtcctcactgggagagccctgctgctgggggagaagggctgcgaagctccaaacaggccgccgttccgtcacaggcaaggggctgtgtacgcgtgcaccgtgcgttgtttttattacatcctgctccctcagcaatcacggcccctccttctacccactggagggctgcgaacatcactgcggggcccacctcattgtccgtcagactctgtaccgaggacggggtcctgaactgtgtggatgatgagccaagggttccggaacatcatctccaaggagggggtgtgggaggtgggtcctggtgagagccttggaccctgtccctcggcgggaggggcagtggcaccaagctgcaattttccaccccgcccctgctgtggccccgactcttgccatgtccctggggctgctgagcaaggtttgtagaaaatcacataacgatgagcactggggcctctccaaactcctgctcacgcactcaggcgtaaccaacctccgcacctcccagcatcccacctgtccctgtgggcctttttggcagaggtggggcccacctaccccagagagcctgaagaagtttccttgctacaagcccaagcgtggccaggtatagcaatgggtgtgcaggtaaaggaagaaacatccaaattaattttgcaactttaatgtaacactgatacccaaaacatgaaaacacaaggaaaagcacaaaatgaaagcaggaagagcaaagagagcttcatcttgcatgccacctccgactgacaggaagaagccgcctagggtgctgtgtcgagaaggaatctgagaggaggcgctctggcttggccagtaagatcgctgcagttcgtcaacggtgcctataaaagcacaagaaaccaaagtgacaacatccgtggacacacgcgaaccagggaggggtgtacgtaacaaaataagtgtccgtccatgctgttgccgttgcccccagcgcccccaccctggccctccctctgacatctcacccccctccgcagccctcctgcagagtctcatttctctaccgaaactcttactggatccaggagaagaagctggcgccagctctggcagcatttctggtccggatggtggagctggtgctggggccatctaggacgctggtgctggcccctccattggtgccactgctgacgccagctctccacgtggccctcctgttggcacggttgctattcagaatgtactgatggtatctggcccagaaagcaaaggggatcctggcccaggcatcgccaaaatctccgtcctcatcccaggtcaggagctcgacttgtatgtcatcccagctccaccgtccaatcagcgcttcatccccgatattcatctgggccctcatctgggccctggcatgttcctcggccatatccacatccattgtcttgaaagcatcatccacagcctccaagaaatgagccttccattcccgggggtctcggttctgattctgaggaggaaaagggcaggcatagacacagagctaccccacactggctgagcacccgcggcccgcctcaccccctcccgtgtgctttgtgcaatgatggcaaaaatcaggaccacagggattgggggctcctactctcctgtgccagacctgggattttgccccatctgtgaccttgtgtagggtgctcaggtgcctctgtgagtgtttggtaccctcactggaatacggggtaatgggaaggaggcctcgaccaagaaacaagcaaggtgtggagagcaccacccccggtgccgggcacccaacagaggcgctcccttacctgggcgatgaatctcaggaccctcatcttgctggtctcatggcgggctcgcaggccccagaggaattcatactcaggtgggttgctgttggggatcttcttgtattccaggtaccttggcatgagaggaaagtaaactttgctgctagccaagcagacctgttgctgaacggatgggttccagggggcccctcctcaacccgatgccgcagctcagctcctggaagaggactgtcctgcccctccagcccttcactcattcccaaacccactcccaggacttctgcctgcaaaagtgaggccttcaaagccttttgccattggtcctccccggaagccatgcggaggtgcagggggtccacatgtagggcatttgtctgtagggaggccacaagtttgtgcccctcatcacgatgaccccagcttcctgttgggtgtgttgtaaacagaggagccattcttcaggccccctgctctgagcacaccccacctcgagggtcttggccacaccccggcggagccctggagaggcccaccagaggaaacgactggagaggaagaaacagtcagccaggagaagcgtgctccaggcatcctcctcaagtcctgaccctttgttggtgtgcatgcgcgcctgtgcgttggcaagtcctccagggacggggagagggtggcccctggcctgaaaatcaggagagttgggctgaggcccttaccagctgggagccatgctcagaggcgtctcctctctgagctccgggttccttaggtgtaaaccagggggaactcttgtgtcagtctacagggcaggtgctcaaggtgatggcggccgttttcacaccccacaccgtgttctcaggtgacgtgagctcccttttcccaagaccgccctggccttcggctccccacacactcgcataccccccactgccactcactcccaggtcagaggcacccatccctccagttgaagatttgggatagggaactgctttctcagccagaccagcacacaaaggatgctcgagtgagagccgcagttagctcaggtgatacttacttctgcttcacaaagtcatctgtgatgagcttcctcagatcgccgaggaatgggtgcctcaccctgagggcaaggaaaggaatccatgagcagagacggtggcaggggccctccctagcatgactatgacttcccagcccccggggagtcgctgtggaggcctgggcatgcagcagaggccagaggactgttggtcagggacgccccaggtagggatttgatggaatccctgactctgactgtctctcttagatgtcatctggggccacagagcagagagagggctgagcagcgtccagcaccgcttccccatccgccctggtgagatcctttgctctctaccgagcccagggcaccccacgcccttgcgccagaccaccaggctattgcaatcccaggacctctttggccagaggatagcaccgaggggaggagctggagaggccaatcatacccagggcgcagtcccatcttgcgtagtgcctcccagaggacagctgcgaggggagaggaggtacgagagtttggcacccagaagatgagactatgggcagccccccagttgcaggtccagccactcaccctcgctggcacggttgccattcatgaagatgacgcccagaatcaccaagaggagactcagcctgggagtgtccttggttctaaaggtgtggaaagagaaatcctgtttagcagctatttgcctgagagacaccaccaggctctcccaactagcctctctcaggtttcccagcttgaggggaactcttcccaggacaggcacagttcactagctgctgacagaccattcgcacctccgcctgagacttaatcgcctcctctataaaacatgggtactaacacttccctgacagggttctgcagaggacagggcgaggcagggagccgaagctctgcaaatggcaaacgtgtgcccagagatggctccagacctttcctgccccttccacatcagcacctacactgaagaggcagctctcccctaggccagctctgccaggcccaggccaggcaggcaggaggaagaggcactttcctccgaagctttggggataaagcccggcagcagcttggggagaactgatggcagcaaggcctcaccccaggctatcattcctttcatccagcagtcaccaggcagccctcgctgtgtgtgggagcggtgcgccgcactcaagccccgtcttcctgcttcactgaaggggtgtgggcagggaagggacaccaccgaggaaggccacgacccgctttccctttcttactttccaaggaggcgagctgaggagtcccgtgtgcagacaagaatatacaggtgttcttccttgtcgatctccttcaggtggatcccaaacttctacgtgggggagaaaacagagtgtgagatccaaaccccatgctgggcatcctgccggcagacagtgattccgggttagaactgctcctcagcaaggaatccaaactcgtgagcgagggcagaagaagacagcacacggaagaccttcgctgtgggagctgacgctggcagaggcgatgagacccacctggccagacggcgagacactcagagagcatgagagagagaagccgagggcaggaagcacgagtcaaactgccagtgcagtggaagctcagagtcggagaggtgagagatggctccagagactgggccttgaggggctgcagggtcaccgcacccccatgcccgctcttcccccacagagctgctcccatcctgcacccaccttttccagggtgtacgttgctcgttcaatgatctcagggaaatgttcatcatattctctgatgacatccttcagcatgtctgcaggagggggaagagttggagaaagcacctgggctgagcaggggtcatagagctgtagccccttggtcagctctgccgagggtgacgcagccaggaccccgtcctgtggctatggagggaccagccgtggcacgcaagcaaagggatgcccacagactaggggatggtgaagggggcacaggctgcctacctgcgcgcttgatggggatcttcttgtagtccttaatcatcaggtatttcaccaacttatttgcctggagaaggaggaacatgcggggaggtcaaggcatgggtgacagcagagacgtggcccacaagggaggagaggaaggagatgggggagggtgggcttcttaccctctcctgcagaagggtcacgttgcgggggggcaggcacagtacgtgccttgagggtatctgggacctcggggccatcgggggccgaggggccaactgagcccgcaccgtcaatgagggctgtgatgctctccaggtgggtgggaccgcgggagtctctctctcctcctcgctgctctcatactcatcatccaggtgcttggactgtatcatttgagagaggagagacccagggctaccaggctccccgtgccaaagcacccggcacgcacctcacccgtagcaggctcttggaaatgagagcagtaccagcagcggctggcatgtgctgcgtgcttactaagtgccaggcactgagccagcctcttctcccaccagtcctgagggtagggactacgtggagtgaaaacatgctcagcaaacttgtgttggagaaacatggactagctgagaggagaggaggggaggagaggggaggtgaggagagaaggaggggaaagaggagaagagaggaagaagggggagaggagagggaggagaggagcaggaaagggaggagaaggaaaggacaggagcaagggggtgtggaggtggcagggggcagggggatctcaccttcttggtcctcttgcctcccatcctggcccagggctcagcactgtgctgagcagtggcagcagctgcaccctccggctcagggatgctcgtggccatcttggccttggcagcagctgctgccacaacattctgaggctccacccaccgagtcttggccagcgccttccccgacttggtggtcttgggccgggtggctgccacctccctgccaggtcccgtctggggcacaccagaggcagcactggggccctctgtggcagcctcttgggctggggcaggtctcttggggcgcgggaaggccatgccactgacacctgccggctgagtgaaatcgaagacatcattctggcccaggaaggctgtgctgggccggttggcgtccacctccctggcacacggagcctgagagaaagcacaggcgctactagggccctcagtagcagcctcctgggccggggagcctgtctgggactgtgcggaggttgccggagcctcgggggcagccatcttactggtgactaacatctgggaggtctgcggagaagcaaggggtggctcaggggtgggcccctgagcctcggcggcgtaggtcgtgggctgggtatcctctcctgagacctgcggcgtggccacccggtggctagcgaccacctgactgaaggcggtacgggcagcggcggcagcggcccgagccgcacggttggaggcggcggcgcgggctacgttggcagcacgggcggccgtctcattggcaagtgtttccggatccagctgcaatgcctccaccagggtctgggccagcacagggttttccagttcccagggctcattctgcaaggccagagagaggggttggggaaggcaggccactcgacgacatacttgtgttagcttccctgtgctggccagcctcttcccagcagtcagccctgaacaccccaagaccttcccaaatcttcttcttccgagcaggggagggaaggcttgggaagctgggcagtcctttcccacacaaccctcctggctcccccctcctccctcccccattcacaggggaaaggcccaggccagcaggtgtccaggaaggggcctcaccgataagatgcgaaggcctggacccaagcttccgaaggctctgaggatatggatgtcaaagctggtgagggtgccatagccaccaaacgcaccgaattcttcatagtcgttgccttcaaccatctcttcctccccgacttcgtcgctaccctcatccatgtcttcaacactgtagctttccgattgcacgctgaagcttccctcagccatgctgcgggtcccagggagatgagagctcagcctgagagggagggtgaagcagctgcagggggagggggcgggatccaatgggaggcgggatctcccgggaggtgaggggcgacaatcatcaggttactaggcaatattaggcagtagggggcggggggggggaggaggagcgggggggagacggtttggctttctgatggggtagacctggtcagggacagagcccaaggaaagggacagaggaggtcgcaggaggcgccgcactgaaagcggagtttaggatgggcaggctcgccatcccagcggctagatttgacgagggggtgttctggagggctggggtccgaagagtcccaaagggaatgcattggggaagagagaaacaaagggtttggatttacgggccagagaaggggaccgggatgaagggggagcagatgggagagctcagacaacagggacagtggcaagccgcaagctctgcgaaacagaaccccagggacctttggctaggtccgggcggggggcctaggtggggctcagactcgagcactagaggcggatggagtgggggcctcagacctaggtgaggctccaatcggagcgctgcagatctcaaacgcgaggactgggcactccaggaagggggcaagcggtcagctcggttcgagtaatctaggagtggttggggtgggggtggggcctcaggtccaagggagctcagctcggagcacacgggtctgctaaaggggtgaggatcctgggctccggtttcagtagggctcagatcggggcgcctgggtctgatggtgatgggggctcctatctagaccttgggtctaatggggttccggttctgagtgcttgggctttgttcagatccggaggcggagggagggcgcagcgtgtcgggttccactcgccctctcccggtcctgtctggggctggatccttaccttctcgggaactccaatggcgtccgtcctcagcaccaggaaccccgcagccgcgccctcgcctactgctgccagcacagcagcccggaccaccccgccccttttctccgtgcaccccccgcggctgggtagcctgcgcatgcgcggacccctccagcccgcccgctttcccaacaaaagccctttcctccaggtctccagtgcgcatgcgattccgcgggtgggtgggcggtggggtcgaaggtagggtgcggggggctcttcccgccagatccacttcacctctcctcctcctcctcctcctaccgcgggcgcgcacactcataccctgcagtgcagctcgacccacccaatcatctcttctcagtccccccacttttgcacaatgcttctctgtcctgccctgccctttcacccaaactcctccagcctggtctgggatacactatgccccgtttccccggcaagaccccttaggtcacaattagtgaggtctcacaattaataagctgggtctctaactgcaacaagtggaaatcctcaacctgcggggctacgaaatggacatggccagaggatggcacttcgctttgtgtgcttctccactagccaactctctggcccccagacatactgggaacatctgcttcctcagctaccctttatgcagcttgtatgtcacagagggatctgtgctggggcttttcttcctctcacagcagcgctgggaagtggatgtcagcatccccatttggcgtgtcaggaagctgaggcacagacacattgcatgaactagaccacagagccaggaaacagaaaatgcaaaatttgaacctgggtcttccggactccaaagtccacctcctgctcctgctggcctggggacagaggcaccgcctcctccgtctgagtgacaggcctcccccaccccaacatctgtcccaaagaagcaaggtttgtgctgtagaaggcctaagttcatgctccgcattcaggacacagggagacagagcctccccccgcctcgcccccagcctctgcggctctatgtgggtccatccaggtatgagaattgctccaccgggtccactctctactcagattgtcaggcctcttccttatcagcgatacaatcacgctgccgctgagaccctcctggtgtccgccaggacaattagacacctgtgtgtctgagctaattactccacaatctacaagcccagttcaaacttcacttttgaggtccaagtgcatagtacattcacctgcctacgtgacatctccacttggatgtcttttgaggcagaaaatgctgtggtctcatctgcagtcgaacctggactgtttgtaaaattcgtagtagatttttatatttgtttttatgtcagcctcaccaggacccctgtgtatgaatggaaggtattgctaggacagcagcttttactctccgctgaccagtatccattctgcctggctctgtggttttctccagctgttatatatcaatctctcctgtcagctgcttgtgcctctttagcccttcccctgtaacatatcctctgcgggagaggaacacaccctacaaacgaaagccttcagaaagtgctacgtgctaatcactccaaaaaatctacaaccccagtctgaacttcacttttgaggtccaagtacatacattcacccacctacgtggcatctccacttggaagtctcaagggctcttcatggtttgcctgtccaaaactggtcacttggtatactcactcctcccatacactcacacatccccatcgctcctgttccccccccccccaacccatcttcacagtctcagtaaatggcgccattatccacacaaccactcactccagaaactgggagtcatcgatcaccactccccgtttctgatacgctgcatccagaagggcaagctctgaagggtctccagagctgcctctctgtgcagctgtcttctctccattactcccggcaaattctggtcctatggacctcttgagctctcaactctgtctccttcactcagacggtccaccgggctctgttgtgttcagctcccctgtgctgcagcctgcaaactctatccgggcaagaagttggtggaattgggcgatcagagggctcacctggtcaggttccctttctctcagggatcactgtcccgtatgcaggtggtgccatgacgttaagccttataatttttttggtttataggtatttaggcgagacggtaagtccggttcctgttaatccatcatggctggaaatacaagtatccaccggatttcttaattttcttttcactgagccctgtgctttcaggaggcctccacgttgccacgcataatctaaagtatgtccaaggtgctatgcacagagaatccatggtgtgcattcctgacattttacctatctgctcgcccagagatttaccctttctcctaagtaactagaaaatcagaagaaaaccataagaaacatttagatgtccaaagagaagaatgacagcacatttctcattagcaatatgcaagtcagaagtcatgtggcacaccatctttaaaatcgtgaaataaaaataaatgtcaactcttaagtctatactcaatgaatatcttttcaaatgaagttaaaatagtaggtgtttagacatacagaagttgaaagaattgatcatcaatagacttgcactgtaatattttttaaaacttttatgtttgggggtacatgtgaaggtttgttacatagataaacacgtgtcacgggggttcgttgcacacatgactacatcacccaggtattgaactcactatccaagagttatctcttttctgctcctctccgtcatcccaccctcccccttaaggagaccccagtgtctgttgtttccttctttgtgttcataagttcttatcatttagctcccaattctaagtgagaacatgtgggatttgcttttctgttcctgcgttagtttgctgagcttatagcctccagctccatgcctgttcccacaaaagacacggccttgttcttctttatggctgcataatattccatggtgtatatgcaccacattttccgtatccagtctgtcattgatgggcatttatgttgattccacgtttttgctcttgtgaacagtgctgcagtgaatagtccaggtgcatgtgtctttatggtagaatgctttatattcctctggctctatacccagtaatgggattgctgggtcaaatggtagttctgcttttagctctttgaggaattgcgatactgctttccacaatggttgagctaatgtacactcccgccaaccgtgtatatgggtttccttttcttggcaacctcgccagcatctgctattttttgtttttagtaacagccattctgactgttatgggatggtatctcattgtggttttgatttgcatttctctaatgatcagtgatattgagctgtttttcatatacttcttggctacatgtatgtcttcttttgagaagtgtctgttcatgtcatttgcccccttattaatggggttgtttgtttttctcttgtgcatttgtttaggctttttatagatgctggatatcagacctctgttagatgaatagtgttgcaaaaattttctcccactttgtaggttgtctgtttactctgttgatagtttcttttgctgtgcagaagctctaagtttaattagatcccatgtgtcaatttttactcttgctgtgattgcttttggtgcctctgtcgtgagatctttgcctgctcctatgtccaggatggtattgcctaggttgtcttccagggtttttatggtgttgggttttacattaaagcctttaatccatctcatgtggatttttgtagatagtgtaaggaaggggtccagcttcaatcctctgcatacggctagccagttatcacagcaccattgatagaatatggagtctttttcccaccgcttgtttttgtcagctttgtcaaaaaaaaaaaaaaagaaaaaagctggttgtagatgtgcgacattatttatggcctctctattctgttccattggtctatgtgcctgtttttgtgccagtaccagtaccatgctgttttggtcattgtagccttgcagtatagttcttttagcttacgattgccttggctatccgggctccttttctggttccatgtacatttttaaataattgtttctagctctgtgaagaatgtccttggtagttcgatgggaatagcattgaatctataaattgctttaggcagtgtagccactttaatgatattggttcttcctatccatgagcatgggatgtttttccatatgttcatgtctgctctgatttctttgagcagtgttttgtaattctcattgtggagatctttcaccttcctggttagctgtattcctaggtgttttatttttgtgtgtgtggcaattgggaatgggattgcctttctgatttggctctcagtttggttggtggtggtgtataggaatgctagtgatctttgtacattgattgtgtatcctacaacttcgctcaagtcgtttatcagctgaaggagctttttggccaagactatggggttttctagatatagaatcatgtcatctgcaaacagaggtggtttggcttcctttcttcctatttggatacactttatttatttctcttgcctggtcgccctgaccaggtcttccagtacaatgttgagtaggagtaatgagagagggcaaccttgtcttgtgccggtttacaaggagaatgcgtccagcttttgcccattcagtatgatattggcgtgggtttgtcacagatggattttcattattttgaggtatgttccttcaatattgagtttatcgagagtttttaccatgaagagatgttaacttttatcaaaagccttttctgcatctattgagatcaccatacgttttttgtctttagatctgtgtatatgatgaatcacatttattgatttccgtatgttgaaccaaacttgcatcccggggatggagcctacttgatcgtggtggattagctttttgatgtgcagctaggttcggattgccagtattttgttgaggattttcgcatcgatgttcatcaaggatattggcctgaagttttcttttgttgtgtgtgtgtctctgccagattttggtatcaaaatgatgctggcctcatagaatgagttggggagaagtccctcctcctcagtttttgtttttttttttttttttggaatagtttctgtaggaatagcaccagctcttctttgtacatctggtagaattagctgtgaattcctcgggtccttttttcttgttgttgttgtagttgttttgttgttgttcttgttgttaggctatttattactgaatcaatttcagagctcattattggtgtgttcaggaaccaatttcttcctggctccatcttgggagggtgtatttgattgatttgggaggaatttattgatttcttgtaggttttctagtttgtgtctatacaggtgttcataacagtctctggggtttttcggtacttctctggggttggtggtaatgtccactgtgtcatttctgagtgtgtttattaggatcttctctcttttttttaaaaattagtctagataggggtttatcagtcttattttttctttcaaataaccaacacctggtttcattgatcttttgtatggttttttgcaacttaaattcattcagttaagttctgatttttgttacttcttgttttctgctagctttggggttggcttgctcttgtttttctggttcctctaggtatgatgttagattattaatttgagatctttctaagtttttgacatgggcattttgcactaaaaactttcctcttaacactgctttagcagtgtcccagagattctggtatgtggtagctttgttttcattaatctcaaagaatttcttgatttctgccttaatttcattgtttacccaaaagtcactcaggagcagtttgtttaatatccttgttattgtatggttttaaatgatcttcttagtattgatttctgtttttattgtattgtggtctgagagggtggttggtaatttttcggtttgtttttattttgctgaaaattgatttatggccaattgtgtgctcagttttacagtatgtttcatgtgcagatgagaagaatgtagatactgttgttttggggtgtagagtcctgtagaatagtctgttcagtctatgtggtcaagcatactgttcagatcccggataactttgttagttttctgcctgatgatctgtctaatactgtcagtggggtgttgaagtctcccaccattattttgtggttatctaagaccctctgtcagtctctaagaacttgttttatgaatctgaatgatcctgttgttaggtgccagtgctcctattgttgggtgcatatatatttaggattgctaagccttcttgttgaattgaaccctttacccttatgtaatgccctctttgaggaaattacaactttcttcatctttttggttttggcaaagattttcaaaatgagacacccaaaccacaaactataaaagaagaaaaattaatacatttgattccaccacaattaaagtttttggcctttaaaaggcattcttttgaaattgaaagagaaatccacactctgtgataaaatatttagaattcatatatctatatccaacacaggacacttctagactataaagaagtcttataactcaattataagaaggcaaatactcaactataaatatggagaaaagacttcaacagactacctcaccaaagaagatacacagatggctaacaaccacacaaaaagataccatcatttatcattcaggaaatgcagattaaaatcaaatttaaatactgtcgtagatacatgagcatgattgaaattaaaataactgattatacccagtgctagcaatgatgtggaacttctgaatgatggaaacacttcggaaattggtttggtagtcgcttacccagttaaatattcacctcccataaaccagccattccactccaagacatacacaggagaaaagaaaatatattttcatatgattacttgtttatgaatattcatagcaaatttatttgtaatagccaaaagcctgaagacaacccaagtgtccatcaacagggagatgaattatgaaattgtgctatgtccatacaacggaatactacagcgcattaaaaagaaatgaattgttgatacttatgacaacataaacgcatctgaaaatatgctctctgaaagaagctaaaccaaaaaaaaagggtgcagggagtaagattacgtttattaaaattctggaatttcaaaggagcccgaggatatatttttgtttgtaatacaggtgttcattatcattactataatgattgtttcacaggtgtgataccaaaacttattagatcatatatgttaaatatgctcagtctaacatatgtcgattataattaataaagatgtaaagaagccgggcgtggtggctcacgcctgttatcccagcactttgtgggggcgaggcaggaagatcgcttgaggccaggagttgaagatcaacctcaccaacatagtgagccccagtcactataaaaaatttaaaaattagccaggtgtgatggggcatgcctccagtcccagccacttgggagactgaggcaggagtatcacttgagccaaggagttccgggctgcagtaagctaagaagatgccactgcactgcagctggggtgacagagtgagaccctatctcgaaaaaaataaaaaatagacacagtatgggatatccctatctatctatatatcatattatataatatgcataatgatatatctaaaaataatcttacgtaaaacaagaacacatgtcacactttacgtgtttttatcacataagaaaaatgataaataataaacatattagaatggtacatttagatgagcagtgcacagtgggagtagagagtgcaaacaaaaaggatcaaataaatgaatggcaacaagaacggggccttgcctaaaagaatggcaagaacagtgatatgagttggaaatgattttctcaacactctgaccctaacgtatccccaccctccccttgcctgaattattctgaccttctcttagtcccctgttgaagccatgcttgttggtcttagcgactgactttacagttttgctcccaatacgcctgaactggtaaccctctttgctgttcacctgtctacctcatgcttatatccaagtcctcagcttaaatgtcacttcttcatgatagcattttctggccacaaaacacttcaccctcaatttaaattattttttctcttttactttctcttagtcctctggaaacttcctctataccatttatcccagtatatgtcataatgatacacagttttagagggattctttttgaaacatctctctccccattgcagtgaaagccccagggtgaaagttatcattgtctgttttcttctccactgtatatcctaagggcctgcctagtccagtgactgttatatattagaatctcaaatatgtttgttggaggcatgaatgagtgaatgaatgaatgagttgaaaaaccaaatggaaaagatggatggcttgacagagagactggtgaatacatgtaagtactgatgatctttccacatgttggcttccctggtagtggggaaacagccagagatgtgtgtgggagagcaaagtgatgaaagagtcccaaacctggaatatagaaggagaaagcatgaataggagaaggatggaatgaaaagccagttggaggactgaaatgatgcaggaaggagggggagagagagagaaagaaagggagatagatagatagatgatagatagatagatagatagatagatagatagatagatagatgatagatagatagatagatagatagatagcagcaaacagagagggcagaggcaggggagatgagggagcgatggaggagagagacaggaggttgtactacaaggtgacaagcagaaagccaggagcaggaagaaagcacaggaacatgtcttcctgacagctgtgcagtgatcaaaatatgaaacaccacaagttccccttttcttttccttaccacaagctcttaactttagctatgagaaattaaagctgtttgtaaaacctaaaggtaccactttaggcattgcttttggtgaaaagctagttgctgacatctcagcagtaataaagctgcagggaaagggacaaggacaagaaggcactcctctttcagaagcaagctgcattcatgtgtctgtgtgggaaacacatattgcaagggtagtagactgatatagggtttctcctttaatttttgttaaggagaaaaataatgaaatatcaactcttttgtataatatgccatggagaattccccactatggggcgcaagggatgaaactgaatcattttctcagggacaaaacaaggaattcagaatggaatttgccccgctgctggcattggaaattcattatatcaaacttctaaaatgaaatagagaatttaatttcagaagccataaaaatattgtaaccatcatcattagataccaagaatgtttttgcaggtattgtaagagtaaggagactcagagaaaacagtcattttctttaaatgttgatttttccaaagctccacggtgttttaattcaccataagcgtgaattgttacttgaccctgatagagtattatgcgcaatatcttgcatagtttaatgagctctaatggagaaatgcttcccatactgaaatctctgtaatactgtgattttagctttcacataagctcttcctttcctctctcctgaaatatgggttaggttacattttacaatgattcaagtctgactaccttttaatggtgcctgtggcatgggtatggctttacaatggtatttatttgggaaggacagaggaaaaaaccattatgacaacttgtaagagtccagcattggttatccattggtaactagcagccttagaacagttaatacagacttaaccaagtggctgatcaaccagcatacttgtaaggctcgttgttaagaaaaaaaattataatcaaataatccctttttatcttaagatccttttgtggagagtgtgggtggtgactggtgagaagccaaaaagtattgtgccaaatattttcaaaatattacttagtaatagctataatagatttctcaagagaccagtagtgatatatattgtctatttcaaggcaattataaaatgtgagatccatttttaaaattgcgtgcaaagaaagacgattatttagatataggggagtacttactgaagaggacctaaatgatcagttctaactgagaaatagcagaagccagtgacttggccatgggatgtgttttcaacttgcaccatctaaatgtcaaattcaaagttcttagagatcaaatgaggcctaaataaggatcacttgctttctatgagactagtgtaaggtctcacagaaacatccacaagaaacaacagcagacagggaactatgacctccccaaatggacaaaccgagaaacaactgactgaccctaatgagatgatcatatgtgagccctctgaccaataattcaaaatagtagttttaaggaaatgcggtcatctccaagataacacagaaaatcaattgtggaatttatgagagaaataaatttatgtatgtatgtatgtatttatttatttttagtttttgtagagacggggtctctctatattgcccaggctagtctcaaactcctggcctcaagtgatctgcctgcttcagcctccccaaatgctggtattacaggcatgagccaccatgcccagcctatgagagaaatttaacacagagattgaaataataaaacaaatcaaacagaaatcttggaacagaaatatttattttctaatgaactgaaaaattcattagaggccctcatctgcagactggatcaaacaaaaaagaatcagtgggctcaaagataggctacttgaaaacacatagtcaaaggagaaaaaagaatgatagggaatgaagatcatctgcgagatacagaaaattacctcaaaataacaaatctaagaattattggtgttcaagaggaatttgagcaagatcaaggggtagaaagtttattcaaagaaatgctgacagaaaactttccaaaacttgagaaagaaagaaatatatcaggtacaggaaggttagataacaccaaacagataaaactcaagtaaaactacccaagggcatataataatcaagctatcaaaggtcaagagcaaagagagaatcttaaaagcagcaaagaaaagaagcaagtaacatataaaggagttccaattcatctggcaacaaacttctcaatggaaaccatacagattgggagtgggagagagttttattacattttcaaaatgctgaaaaaaatactgtcatttaataatactgtatccagccaagctactcatcaaaaatgaagaacagataaatactttcccaggcaaacagaagctgagagaattttccaccatcaaatccatcttacgagaaattctaaagggagttattcaatctgaaaaaaaaagccactaaatattcaacaataaaccatttgaaagtataaaacccactggtaaaattaagtacacagacaaacccagaatactctaatactgtaattgtggtgagcagtctactcatatctctagtatgaagcccaaaagccaaatctatcaaaacaataatagctacaacaacctgttaagagatatgcaataagaaagtatgtaacttgagacaacaaaaagtcaaaatatagagggatggagttaaagtgtacagggttgtttttatttgtttctattatttttgtcatctcattaaaataacttgttatatctataagatattttttgcaagcctcatggtaaccacaatgcaaaaaactataatagatacacaaaaagtaaaaaagcaatgaattaaaatatagtgccagagaaaatcatttaaccacaaaggaagtcagtaagaaaggaagaaagaagcagaaaaattgtgaaacaaccagaaaacaagcaacaaaatggcagtagtaagtccttaccaataatagcactgaatgcaaatgaaccaaattctcgaattaaaaacataaaactctattttccagaatggataaaaacaaaacccaactgtatgttgcctacaagaaacccatctcacatataaagacaaacacagactaaaagtgaaggaacagaaaaagatattctgcccaagtggaaactaaaaaagagcaggctcaactatacttacattagataaaatacactacaaatcaaaggctataaaaagatacaaagaaggtcactataaaatgataaaggaatcaattcagcaagtagctataaccattataaatatctacacaggcaacaccagagcttccaagtatataaatcaaacattagcaggtctgaatggagagatagactgaaatgcaatagtaatagaggacttcaacaccccactttcagtaatggacagatcatctagacagaaaattgacaaagaaacatttcagctaaactacactctagatcaaatggacctaactaatgttacagagtatttcatccaaatgctgcataatacacattcttttcatcagcacatggaacattctccagaataaaccataccttgggccacaaaataattctcatcaaattaaaaaaaaagtgggaatcatatcaaggatcttttctttctttcatgattttaacttttattttagattcagggggtacacgtgcaggtttgttacatgggtatattgtgtgatgctgaagtttgggatatgaatgatcctatcacccaggtagtgagcataggacccaaaagttagtttctcatttctccccagtccctcactccatcttctagtagtccccagtgttaattattgccatctttatgtccacaagtacccaatgattagctcccacttataagtgagaacatgcagtatttggttttctgcagttatgttaatccataggatagtggcctccagctgcatccacgttgctgcaaaggaaatgatttagttattttttatggcaatgtgatattccatagtgtatcatgtaccacattttctttatccaatctaccattgatgggcacctaggttgattccatgtctttgctatttgaatagtgttgtgatgcccatacaagtgcatgtgtctttttggtagaatagtttactttcttttggatatatattcagtaatggaattgctgggttgaatggtagttctgttttaagttatttgagaaatctccaaactgctttccatagttgctggactaatttacattcccaccaacagtgtataagcatttccttttctttgcagcctcaccagaatctgttgttttttgacgttttgttaatagccattctgcctggcatgagatggtatctcattgtggtttcgcttcgcatttctctgatgagtaatgatgtggagcatttttttcgtatgtttgttggccacatgtcttcttttgagaagtatctgttcatgtcttttgaccactttttaatggggttatttattttttgcttgtgaaattgtttatattccatataaattctggatattagactttttccaggtacatagtttgcaaatattttctcccattctgtaggttgtcttttcactctgttgatagtttcttttgctgtgcagaagctctttaggttacttaggttctacttgtcaatttttctttttggcaattgcttttgaggacttagtcataaattctttcacaaggtcaatgtctagaatggtgttccctgggtttgctcctatgattcttttagttttaggtcttatgtttaagtatttaatccattttgagttgatttctctatatggtgaaaggtaagggtccagtttcattcttctgcatatggctagctagttatcccagcatcatttattgaataggcagtcctttttccattgcttattttgtagttattttttcccgatcctctccctcctcccaccctctgccctccagtaggccccagtgtgtgttgttcctttgtatgtgtccatatgttcttatcatttagctcacacttataagtgagaacatgaggtatttggttttctgttcctgtgttagtttgctaaggataatggcctccagctccatccatgttgctgccaagaacatgatctcattcttttatggcttcatagtattccatggtgtatatgtactacattttctttatccagcctatcactgatggacatttaggttgattccatgtctttgctattgtgaatagtgctgcaattaacatttgcatgcatgtgtctttataatagaatgatttatattcctttgagtatatacccagtaatgggattgctgagtcaaatggtatttctttctctagatctttgaggaatcaccacaccgtcttctacaatggatgaactaatttacactcccaccaacagtttaaaagcattcctttttctccacaacctcgccagcatgttattttttgactttttaataatagccattctgactggtgtgagatggtatctcattgtggttttgatttgcatttctctaatgattagttatgtggagctttttaaatatgattgttggccacatgcacgtcttcttttaagaagtggctgttcatgtccgttgctcactttttaatggggttgtttgtttttttcttgtaaatttaagtttcttatagataatgggtattagacctttgtaagatgcatagtttacaaaaattttctcccattctgtaggttgtctgtttactctgttcacaatttcttttgcagtgcagaagctctttagtttaattagatctcgtttgtcaatttttgtatttattgcaatttcttttggttgtctttatcatgaaatctttgcttgtgcctgtgtcctgaatgagattgactaggttttcttctattttttatagttttgggttttacatttaagtatttaatccaactggagttgatttttgtatatggtataaggaaggggtccagtgtcagttttccacatatggctagcctgttctcccagcatcatttattaaatatggaattctctccccattgcttttttttggtcaggtttgttgaaaataaggtgtaggtgtgtggtctcctttccgggttccctattctgttccattggtctatgtgtctgttcttgtaccagtaccatgctggtttggttactactgccttgtagtatagtttgaagtcgggtagcgtgttatctccagctttgttctttttgcttaagattgccttggctcttcagactcttttttggttccatatgaattttaaaatagttttttctagttctgtgaagaatatcaatagtagtttaatgggaatagcattgaatctataaattgctttgggcagtatggccattttcacaatattgattctttctatccatgcccatggaatgatttccaatttgttagtgtcatctctgatttctttgagcagtggtttgtagttctacatgtagaggtccttcatttcccttgttagctgtatttctaggtattttattcttttttatggcaattgtgaatgggagttcatttgtgatttagctcttggcttgcttgtcggtggtgtatagaattgctagagatttttgcacactggttttgtatcctgagactttgttgaagttgcttatcagcttaagaagcttttgggctgagattatggggttttctagatataggatcatgtcatctgcaaacagggatagtttgacttctcttcctatttgaatagactttatttctttctcttgcctgattgccctggccagaacttctaatactatgttgaataggagttgtgagagagggcaactttgtcttgtgccagtttacaaggggaatgcttccagcatttgctcattcagtatgatgctgcctgtgggtttgtcatagttggctcttattattttgaggtacgttccttcaatacctagtttattgagagtttttaacatgaaaggatgtttaatgttatcaaaagtcttttctgtacctattgaggtaatcatgtagcttttgtctttagttctgtttatgtgattattaattttcatatgttgaatcaaccttgcatcccaaggatgaagcctacttgatcatggtggataagctttttaatgtgctgctggattcaatttgcaagtattttgttgagaatttctgcatctatgtttatcaagaatattggcctgaagttttctttttttgttgtgtctctgccaggttttagtatcagaatgatgctggcctcatggaatgagttagagaggagtccttccttttccattttttggaatagtttcagtaggaatgataccagctcttccttgtgtatctggtagagtttagttgtgaattcacctggtcctgggattttttttttttttggttggtagactatccattactgtctcaatttcagaacttgttattggtctgttcagggattcaatttctttctggttcagtcttgggagggtgtatgtgtccaggaatttatagatttcttctagatgttctagtttatgtgcatagacatgttcatattattctcttatggttgtctttatttctgtggtaatatcccccttgcagtttctgattatatctatttaaatcttctctctttttttctttattagtatagctagcagtctatctatttcattaatttttcaagaaaacagctccagtattcattgattttttgaatggtttattgtgtgtctatctcctttagttcagctctgattttggttatttattttcttctcctagctttgggacttgtttgctgttggttctctagtacttttagttgtaatgttaggttgttacttgagatcttcctattttttatgtcagcatttagtgctataaatttctctcttaacactgccttagctgtgtcccagaaattctggtacattgtatctttgttctcatcagttacaaagaactttttgatttctgctttaatttcattatttacccaaaagtcattcaggaacaggttattcaacttccacgtaattgaatagttttgagtgaatttcttagtcttaattttaaatttgatcctgctgtggtccaagagactttttattattatttcagttcttttgcagttgctgaggagtgttttacttccaattattgactaattttcaagtaagtgccatgtggcaattagaaaaatgtatattcctttgtgcttgggtggagagttctgtagatatcttatcaggtttatttgatcaagagctgagttcaggttctgaatatttttattaattttctgtcttagtgatctatctaatattgtcagtgtggcattaaactctctgcctattattgtgtgggagtctaagtctctttgaaggtccctaagaacttgctttatgaatctaggtgctcctgtgttgggtgcacatatattaaggatagctaggtcttcttgttgaattgaaccctttaccattatgtaatgcccttctttgtcttttaaaatctttgttgatttaaagtctgttttgtcagaaactagaattgcaacccctgcttttcctgtttttcatttgcttggtagattttcctccacccctttattttgagcctaggggtgtcattgcatgtgagatgggtctattgaagacagcataccaatgagtcttggttctttacccagcttgccactctgtgtcttttaattggggaatttagcctatttacatataaggttagtattgatatgtgtggatttggtccttgcatcatgatgttagctggttattttgcaaacttgtttatgtggtttctttataatgtcactggtctgtgtacttcagtgtgtttttgtcatggctggtaagggtcttttctgtccatatttaatgcttccctcaggggctcttgtaaggcagatctagtggtaacaagtacctttagcatttgcttgtctgaaaaggatcctttttctccttcacttatgaagctttgtttgggtagatatgaaattctgggttggaatttcttctctttaaaaatgttgaatattggccctcaatctcttctggcctataggatttcagctgagaggtctgctgttagcctgatgggcttccctttgtgggtgacctagcctttctttctagctgtttttaacattttttctttcatttcaaccttggagaatctgatgattatgtgtcttggggatgatcttcttgtggtgtatcttgctggggttctgtgcatttcctgaatttgaatgttcgcctctctagcaaggttggggaagttctcatagatgatatcgtgaaatgtgttttccaagttggttccattctccctgtctctttcaggtatgccagtcacagattcagttgctttatataatcttatatttcttagaggttttgttcatttcttttcattctttcttctctattcttgtctgcctgtcttgtttcagaaagccagtcttcaagctctgagactctttcctctgcttggtctattctgctattaatacttgtgatgggattatggaattcttgcagtgtgttttacagctctatcaggttggttacctacttctctatactgactagtttatctgtcagctcctgcaatgttttatcatgatttttagcttccttccattgggttacaacatactcttttagctcagtgaactttatttctgtccgtattctgaattctacttttgtcattttggccatctcagcctcagccttggtctgaacccttgatggagaggtgatgtggtcatttggaataaagagggcactctggatttttgagtttccagcgttcttgcactgattctttctcatctttgtgggcttctccatcttcaattcttgagattgctgaactctggacctttttttttcttttaatagtctggccacttttctgtagggctgctgcagtatactggggttccactcacccctagtcacctcagattttccagtaactgaaagtatcaccagtctgtgaaacaacaaagatgaaagcctgccccttcctctgggagctccatcccagggaagtacagacctgttgctagcctgaacacacctgtaggaggtggctggagaccccagatgggaagtctgacccagtcagaaagaatgggattgggacctgctttaaaaagtagcctgacaaagttttcacacagcaattgtgctatgctgggggtccacttcagcccctggttgcctcagacactgtgaagcccaaaggctggaatggctaagttgcacaaacagcaaagatggaggcctgccactcctcccgggagctgtgtcccaaggaggcctgaaacctctgtcagctggagaacgctggtgggggtagctggagaccctggttgggaggctctacctggtgatgaagaacagggttaaggacatgcttaaaaaagcactctggccatgtttttgtggggctgttgtgctgtgctggggtactgtgtccactcctgttcagtttaggccctccaaagcccaaaggctggaactgctaagttgtccaaacagcaaatatggtggcctacccctccctctgggagttccatcccatggagctttcaaatcactttcagctgtagaacactggcagtgttggttggaggccctggttgggagtttctgcccagtgagaaggaatggaatcagtggccacttaaagaagcagtctggccattctttggtagagcagttgtgctgtgctgggggatcccttctgtcccagttggtttggactctccaaagcccacaagctggaatggcttgcccaaagatggcagccttcccctccccttggaagctctgtcccagggaagcacaacactgctaccagtgactggctgaaattcccagccagtgggccttgtcctgtgaggcattgtggaagtggggaccgcagactgtcactgcttggcttcctggattcaggctctttcctagaagtatgtagggggatctaacttcccagtttgccagagttgcagttactttttctgggaagcccagagccagacagagtatctaaagctcctgggtctccatgaatgcctgagtggctgctctgccaaggctctgatacaggaggggggcagggatgtgctgggtagagaagggcagggtccctggcaagggctgcaccatcaggctcgttcccatgaacctaagtgagaactggcactcctgttttcatacccaaatgttgcattttccaagaccactctggcctgccatgcctctcatcctgtgcccataaaaacctgagaccatagcagacacacacacaagcacctgggtgtcaagaggagcagaacagcacaccgacagacaccagcagacaccggcaggccatcggatggccagatggtgtggaattcggtcaggggtggttggaagagtctggccactgggtggcccaactccaggggaagaccgtcttcccactccattccccttttggctccccatccatctcactgagaactacttccgccactcaataaaacctttcactctttctccaagcccatgtgtgatccaatttttccagtacactagggcaagaacccaggatacagaaagtgaccctacccaaatctcatgtcgaatcataatccccaatgttggaggaggagccttgtgagaggtgattggatcatgggggcggactttccccttgctgttctcgtggtagtgagttctcatgagatctggttgttcaaaagtgtgtagcacctcccccttcgctaccttcctctttctctggccatctaagatgtacttgctttcccttcaccttccaccatgatggtaagtttcctgaggcctccccagccatgcttcctgtacagcctgtggaactgaatcaaattaaacctcttttatttataaattacccagtctcaggtagttctttatagcaacgcaagaacagaataatacacacatgtaccctgaaaatatgtacagctattaggtatcaaaaaagaaaagaccactacaagccaatatctctcatgaccacagttgaaaaattattaacacaatttcagcaaatattaataaaatccaacaatctaaaggaatgaaatatacattctgaccaagatgtgtgtatcccagaaatacaaatgtggttttacatttgaaaagcaatttaattttctttaatattctaaaaatgtataatgatctcatagatgaagaaaacaattgacaaaacccaacatccattactgataaaatgtctctcagaaaaatgtgaatagacaatacctctcccaagctggtaaagggcaatttcctacaagtaagataacattaaatgagaggccaaatgctttccacacaatattaggaaaaaagggaagaataatcactcttcaccacttctgtttaaagtgcaataagcaataaagtaagaaaatgaaataaaattaacattatcagaaaggaagaagtaaaaatgtctttatcaggagatgatatgtagaaaatcctaaggaatctacaaaaggctactagaattaatgataagttgggaagttttcaggatataacattgatctatagtaataaactatatttctatactctagcaatgaattctatatactggttaaattaatgaaccagcaatgtagtagaaattgagataatgcattaataaattgataaaatattttcaagacctgcacattactatagcacactaagtgactacattacttagggtaattaaagaaaatgtaaataaatggagaaattagctgtattcttagatttgtagacttaatgttgttaaggtatcaattttctccaaattgttttatacatttaattcaatcacagttaaaaccccagaaggctttttccatagaaattgacaaggttattataaaatttatctgatagtgcaaatgccttacaatataagaaacaattttgacaagagcaaattaaagaacttacactatatgacttcaagagttattacaaagtagtagtaattaaaaccatgaaatattgaggtataaatgaacagaagtaaagttaataaagatacacatagaagttcaatcaatttttgacaaagttgacaattcaataaataaaaaatattttcaataaatactatgaatacaattggattactattaacaacatagtaaatttcaatcactacttcatacaatatacaaaaagtaactgaaaaggattataaacctaaatttaaaaactaaaactataaattattagaagaaaatgtaagacatagagaaaagatcttattgacattgtgtttagcaatgatttcttaagtcagacacaaaaagagcaaactatataagaacaatatcaataaattgaacttaatcaaaattaaaatcatttggctttcaaaatacactattaagaaagtaaaaatgctgccgggcgccgtggctcacgcctgtaatcccagcactttgggaggcccaggcaggcggatcacgaggtcaggagatggagaccatcctggctaacacggtgaaaccccatatctactagaaatacaaaaagaatttagccaggcgtggtggcgggcgcctgtagtcccagctactcggtaggctgaggcaggagaatggcatgaacctgggagacagagcttgcagtaagccgagattgcaccactgaactccagcctgggcgacagagagagactctgtctcaaaaaaaaaaaaagtaagtaaaaatgcaatttaaagagtattaaaaatacttgtagacatacatatgatacttgtatctagaatgtgtagaaaccttcacaattcaaacataagaatacaaaacatgcaataaaaatagggaaaatatttgaagagacacttcacaatgcagataaactgaaggcaaatcagatatgaaaatatgctcaacatctttagttattaggaaaatacaaattacaaaaaaataagatgcccctacacaacaactaagatggctaaatttaaaacatagattgtccatattaagtgttgtcaagtgtgatgaccagttgaaacttgcgtacactttgtggtaatgtaaaataataccaccactttggaaaatggtttgctggtttcttaaaagcttaaacactcacctaccatatcatctagccataacactcatgcatttacccaagtgaaaagaaagaatgtgatgtgatggttaattttatctgtcaatttgacgaagaatgctcttatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttccatcccagggatgaagcccacttgatcacggtggataagctctttgatgtgctgctgaaatcggtttgccagtattttattgaggatttctgcatcagtgttcatcaaggatattggtctaaaattctcttttttggctgtgactctgcccggctttgctatcaggatgatgctggcctcataaaatgagttagggaggattccctctttttctattgattggaatagtttcagaaggaatggtaccagttcctccttgtacctctggtagaattcggctgtgaatccatctggtcctgaactttttttggttggtaagctattaattattgcctcaatttcagctcctgttattggtctattcagagattcaacttcttcctcgtttagtcttgggagaatgtatgtgtcgaggaatttctccatttcttctagattttccagtttatttgcgtagagatgtttgtactattctctgatggtagtttgtatttctgtgggatcagtggtgatatcccctttatcatttttattgcatctatttgattcttctctctttttttctttattagtcttctagcggtctatcaattttgttgatcctttcaaaaaaccagctcctggattcattaattttttgaagagttttttgtgtctctatttccttcagttctgctctgattgtagttatttattgccttctgctagcttttgaatgtgtttgctgttgcttttctagttcttttaattgtaatgttagggtgtcaattttggatctttcctgctttctcttgtgggcatttagtgctataaatttccctccacacactgctttgaatgcatcccagagattctggtatgcacagccaatatcataccgaatgggcaaaaactggaagcattccctttgaaaactggcacgagacacggatgccctctctcaccactcctattcaacacagtgttggaagttctgcccagggcaattaggcaggagaaggaaataaagggtattcaattaggaaaagaggaagtcaaattgtccctgtttgcagatgacatgattgtatatctagaaaaccccattatctcagcccaaaatctccttaagctgataagcaactgaagcaaagtctcaggatacaaaatcaatatgcaaaaatcacaagcattcttatacaccaacaacagacaaacagagagccaaatgatgagtgaactcccattcacaatggcttcaaagagaatgaaatacctaggaatccaacttacaaaggacgtgaaggacctctttaaggagaactacaaaccactgctcaaggaaataaaagaggatacaaacaaatggaagaacattccatgctcatgggtaggaagaatcaatatcgtaaaaatggccatactgcccaaggtaatttacagattcaatgccatccccatcaagctaccaatgactttcttcacagaattggaaaaaactactttaaagttcataaggaaccgaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctatgactatctgatctttgacaaacctaacaaaaacaagcaatgaggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaaggaaatgtaggcattaccattcaggacataggcttgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttctcaacctactcatctgacaaagggctaatatccagaatctacaatgaactcaagcaaatttacaagaaaaaaaacaaacaaccccatcaaaaagtgggcaaaggacatgaacagacacttctcaaaagaagacatttatgcagccaaaaaacacatgaaaaaatgctcagaatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactggaaactagttcaacccttgtggaagtcagtgtggtgattcctcagggatctagaactagaaataccatttgacccagccatcccattactgggtatatacccaaagtactataaatcatgctgctataaagacacatgcacaagtatgtttattgcagcattattcacaatagcaaagacttggaaccaacccaaatgtccaacaatgatagactggattaagaaaatgtggcacatatacaccatggaatactatgcagccataaaaaatgatgagttcatgtcatttgtagggacatggatgaaattggaaatcatcattctcagtaaactatcacaagaacaaaaaaccaaacaccgcatattctcactcatagatgggaattgaacaatgagaacacatggacacaggaaggggaacattacactctgggactgttgtggggttgggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaataaaatttaaaaaaagaaaatgtggcacatatacaccatggaatactatgcagccataaaaaatgatgagtttgtgtcctttgtagggacatggatgaagctggaaaccatcattctcagcaaactattgcaaggacaaaaaaccaaacactgtgtgttctcactcatatgtggtaattgaacaatgagaacacatggacacaggaaggggaacatcacacattggcgcctgttgtggggtgagggggcggctgatagcattagaaggtatacctaatgtaaatgatgagttaatgggtgcagcacaccaacatggcacatgtatacatatgtaacaaacctgcacgttgtgcacatgtaccctagaacttaaagtataataaataaataaataaataaataaataaataaagaagaatgctctcaccaatgtaagtgggcatcacccaatctgatgagggcctgaatagaaaaaaaagtccactgatggtagttttggcataggcattgcacatagggaatgcaaatctgtatccagagtatctatttcgctaagtacaaagcactgtcccttccataagggaagctatccagtgtaatcaactgtccaccaggttgatcaccctggagactggtgccataacctggactgaatgttggtctctgctgctggcaggttggacactcaccagtagccatagccaggtcagctttggtgagtagaagttcatgttattgagcccatgcagaaccatcatccctgctaccatggccactgttcataacctcactggacaatgataagagtaaccaggaatagaagcttactggtaaccacaaaattgatcaatcctttccacttaagtattaaaatactcctctgctgaggtcaccctttggtgaacatttacatggaacacaaatatcttcacatttattgcccattaaaagaggtctggctggacaaggtggctcacgcctgtaatctgagcactttaggaggccaaggcgggtggatcacctgagttcaggagttccagaccagcctggccaacatggcaaaaccccatctctactaaaaataagaaaattagctgggcatggtggcaggtgcctgtaatcccagctccttgggaggctgaggcaggagaatcacttgagccttggaggcggagtttgcagtgagccaagatcaagcccttgcactccagcctgggtggcagagcaagatctgtatcaaaaaaagaaaaaaaaagtctacccacatgtctcttccctagaaatatttgtcaccaattttccaattatgctctttccaagtccctgactgtgtttataatttgtatttccctagtaagccaaatcatttgctacagctcacgaatcagtacataatagtgtgtctggctatttctccttccaagcaaagtgtgcaaccaggtacactgcccaaagttcttcccattggaaagatttcccttcataagtctcaattaagaatatcccagagtgggctatagtgctgcatctgtccaattttgagtggtatccacatacgcagagctgtctgtaaactggccccaagtcttctcctcttctgacaacttattgtaaggtactctgcatgagaccataggtatgagctggaagagagaagatggtgtagaaggactgaggaccatgagcatttcaatcactcttttatgtaacttaattgtgcattcagagcctgcttaggcctgatctgtatagaccatttccatttgatgatggtgtgtagctagcttaatcagataacacccactcatgaatggcaactcaggttacatggtaacttagtagcccatggtctagcattcagtttctactaaagcccagtagcagaccaagagctgtttctcaaaaggagaataattatctgaggataatggcagggacttgtttcaaagtcctgaaacattgcactgtgattcacctataggggactgccaaaggttccaaacagcatctttatctcccactgtcacttcaagcaccactggatctgatgcatcatatggcccaagtggcaaagcagcttgcacagcagcctagacctcttgcaggtcttctcctgttctgggcaccactcaaaactagcagcttttcaggtcactcagtgaatgtgtcagagtaacacatccatataagtaatatgttgcctccaagacccaaacaggcccacaacacattgtgtatcttttttggttgtaggagaatctggatgaaacaacgtattcttcactttagaaggaatacattgacatggcccacatcactggacctaaagaaatttcactgaattttagtcagatttatttcccaccctctgacacagaagtaagtctagagtcgttgctacttcttgctcactagctccaatcaccacaatgtcattaatgtaatggaccagtatgatatcagtatgaagggaaagatgatcaaggtccatgcaaagtaaattatggcatagagctagagaattgatgtaactctgaggtatgtagtgaaggtgtgttgctggccttgccaactgaaaacaaacagctctggagggccgaccttgtggaaaagtatgaagaaaaaggcatataccagattaatggctacataccaggtaccagggaatatgttaatttgctcaagcaacgaaacaacatctagcacagcagtgcaattgaagtcaccatttggttaagcttacaagatttcatcatcattctccaaggtccatttattttctgcagagttcaaagagaagaattgaatggagttgtagtgggaatcactacacctgcatctttgaaattgttgataatggcactgatttctaccgttcctccagggatatggtgttgcttttgatttactattttcttaggtagaggcagttctagtgggttccatttggcctttcccaccacagtagccctcatggcacagggcagggaaccaatgtaggaattctgcaagctgctaagtatgtctattccaattatgcattctgaaactagggaaataactacaggatgtatttggggacctactgtgagacagacctgaggtaaaacttcaatgatcacctgacctccatgagctcctactctgactggaggaccacagtgacatttgggatttcctagagtcagtgtcagttcagagctggtgttgagtagttcccaaaaggcctttttctttcttttctccaatgcacagttactcaggtaaaaggccataggcccctttggagaaggctggcagaaatattagcagcataaaattttgttagtgtattggggtctgtcctcaaggaaaaccagcatcccgttcattcaaggagttctgggtctgtaaactggctcaagcctggtaattggttgaggggccatgactctctttttaatgattcaagttagatatttgttcacttgacctagaaattttctgtttatacatatcgagtaaagtttgatcttataagatcaagcataaataacttgccaatgccatgagtcaggctattctgattgctgccttgactctgctgtccatcatggtaaccattcccatgttgcctttggatgatgagtgacatctcttggccttgccacccgaggattcagttactcccagtgcacttaggttttccaattgggaggctatggtttccactgtaaagtctagtctatagagaagagtaatcaaggagctctttaaggatactggggctccactcacaattttatttcttaaagtattgatgaaaggtatgtctctagagcctcctttgtgaatgagtagatcttaaatgacaaatccactgtaacattccaatctccctaagcttttgaatcccttcctctacattaaatcaagggaagttgggcatttccaattcactcaccgtgggccatattttagtccacatttcagcacaccaaccaaactgttagagccatttctaattccccaagttgcaacattaaatgcagaatctctgctaagtcaactgttatcaatatatagttggcctgatcaaattttttccttctgcaattagaatgaataaaaactagatgcctatttcttgccatatacaaaagtagaatgaaactagatacctatcttttgccatatacaaaaatcaaatcaaaatggattgaagacataaatctaagaccataaacaatgaaattattatgagaaaacattggtgaaaatctccaggactttggtctgggcaaaaatttcttgagcaatatgcaacaagcacaggcaaccaaagcaaaaatggacaaatggaatcacatcagattaaaaagcttctgcacagcaaagaaaactatcaacaaagtgaagaggcaacccacagaatgggagaaaatacttgcaagctacctacctttttattttttgtgggtacctagtaggcatatatatttgtagagtgcatgagatattgtgatacagccatacaatgtataataataacatcatggaaattgggtatccatcatctcaattatttatcctttctttatggtacaaacaaaccaattatactcttttagttatttattttattttattattattatactttaagttttagggtacatgtacacaatgtgcaggtttgttacatatgtatagatgtgccatgttggtgtgctgcacccattaactcgtcatttagcattagatatatctccaaatgctatccctccccccaccccccaccccacaacagttcccggagtgtgatattccccttcctgtgtccatgtgttcacattgttcagttcccacctatgagtgagaacatacagtgtttgcttttttgtccttgtgatagtttgctgagaatgatggtttccagtttcatccatgtccctacaaaggacatgaactcatcactttttatggctgcatagtattccatagtatatatgtgccacattttcgtaatccagtctatcattgttggacatttggcttggttccaagtctttgctattgtgaatactgccgcaataaacacacgtgtgcatgtgcctttatagcagaatgatttataatcctttgggtatatacccagtaatggaatggctgggtcaaatggtatttctagttctagatccctgaggaatcgccacactgacgttcaaaaaggttgaactagtttacagtcccaccaacagtgtaaaagtgttcctatttctccacatcctctccagtatctgttgtttcctgactttttcatgatcgccattctaactggtgtgagatggtatctcattgtagttttgatttgcatttctctgatggccagtgatgatgagcattttttcatgtgtcttttggctgcataaacgtcttcttttgagaagtgtctgttcatatcctttgcccactttttcatggggttgtttgtttttttcttgtaaatatgtttgagttcattgtagattctggataatagccgtttgtcagatgagtaggttgtgaaaatttcctcccattctgtacgttgcctgttcactctgatggtggtttcttttgctgtgaagaagctctttagttgaattagatcccatttgtcaattttggcttttgttgccattgcttttggtgttttagacatgaagtccttgcccatgcctatgtcttgaatggtattgcctaggttttcttctagggtttttatggttttaggtctaacatataagtctttcatccatcttgaattaatttttgtgtaaggtgtaaggaagggatccagtttcagctttctacatatggctagccagttttcccagcaccatttaataaatacggaatcctttccccattgctttttttttttcagatttgtcaaagatcagatggttgtagatatgcagcattatttctgaggactctattctgttccattgatctatagatctgttttggtaccagtaccatgctgttttggttactatagccttgtagtatagtttgaagtcaggtagtgtgatgcctctggctgtgttcttttggcttaggattgacttggcgatgggggctttttttggttccatatgaactttaaagtagttttttccaattctgtgaagaaagtccttggtagcttgatggggatggcattgaatctataaattaccttgggcagtatggccattttcacagtattgattcttcctacccatgagcatggaatgtttttccatttgtttgtatcctcttttatttccttgagcagtggtttgtagttctctttgaagaggtccttcacatcccttgtaagttggactcctaggtattttattctctttgaagcaattgtgaatgggagttcactcatgatttggctctctgtttgtctgttattggtgtataagaatgcttgtgatttttgcacattgattttgtatcctgagaccttgctgaatttgcttatcagcttaaggagatttttggctgagacaatgggattttctagatatacaatcatgtcatctgcaaacagggacaatttgacttcctctttttctatttgaataccttttatttccttctcctgcttaattgccctggccagcacttccaacactatgctgaatagatgtggtgagagagggcattcctgtcttgggccagttttcaaagggaatgcttccagtctttgcccattcagtatgatattggctgtgagtttgtcattgacagctcttattattttgaaatacgtcccatcaatacctaatttattgagagtttttagcatgaagggctgttgaattttgtgaaaggccttttctgcatctattgagataatcatgtggtttttgttgttggttctgtttatatgctggattacatttattgatttgcgtaagttgaaacagccttgcctcccagggatgaagcccacttgatcatggtggataagctttttgatgtgctgctgtattaagtttgccagtattttgttgaggatttttccatcaatgttcatcaaggatgtgggtctaaaattatcttttttggttgtgtctctgccaggctttggtatcaggatgatgctggcctcataaaatgagttagggaggattccctctttttctattgataggaatagtttcagaaggaatggtaccagctcctccttgtacctctggtagaattcggctgtgaatccatctggtcctggactttttttggttggtaagctattgattattgccacaatttcagagcctgttattggtctatttggagattcaatttcttccttgtttagtcttcagagggcgtatgtgtccaggaatttatccatttcttctagattttctagtttatttgggtagagatgtttgtagtattctctgatggtagtttgtatttctgcgggatcggtggtgatatcccctttatcattttttattgcgtgtatttgattcttctctcttttcttctttattagtcttgcttgcggtctatcaattttgttgatcctttcagaaaaccagctcctggactcattaattttttgaagggttttttgtgtctttatgtccttcagttctgctctgatcgtagttatttcttgccttctactagcttttgaatgtgtttgctcttgcttttctagttcttctaattgtgatgttagggtgtcaattttggatctttcctgctttctcttgtgggcatttagtgctataaatttccctctacaaactgctttgaaagtgtcccagagattctggtatattatgtctttgttctcattggtttcaaagaacatctttatttgtgccttcatttcgttatgcatccagtagtcattcaggagcaggttcttctgtttccatgtagttgagtggttttgagtgagtttcttaatcctgagttctagtttgacttcactgtggtctgagagacagtttgttataatttctattcttttacatttgctgaggagtgctttacttccaactatgtggtcaattttgtaataggtgtgatgtagtgctgaaaaaaatgtatatactgttgatttggggtggagagttctgtagatgtctattaggtacacttggtgcagagctgagttcaattcctggatatccttgttaactttctgtctcgttgatctgtctaatgttgacagtggggtgttaaagtctcccattattaatgtgtgggagtctaagtctctttgtaggtctctaagaacttgctttatgaatctgggtgctcttgtattgggtgcatatatatttaggatagttagctcttcttgttgaattgatccgtttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcctgactctttatccaatttgccagtctgtgtcttttaattggagcgtttagtccattgacttttaaagttaatattgtcatgtgtgcatttggtcctgtcattatgatgttagctggttattttgctcgttagttgatgcagtttcttcctagccttgatagtctttacaatttggcatgtttttgcagtggctggtaccggttgttcctttccatgtttagtgcttccttcaggagctcttgtagggcaggcctggtggtgataaaatctctcagcatttgcttgtctgtaaaggattttatttctccttcacttatgaagcttagtttggctgaatatgaaattctgggttgaaaattcttttctttaagaatcttgaatattggccccactctcttctggcttgtagagtttctgctgagagatccgctgttagtctgatgggcttccctttgtgggtaacccgacctttctctctggctgcccttaacatttttttccttcatttcaactttggtgaatctgacaattatgtgtctttgagttgctcttctcgaggagtatctttgtggcgttctctgtatttcctgaatctgaatgttggcctgcctttctagattggggaagttctcctggataatatcctgcagagtgttttccaacttggttccattctccctgtcactttcaggtacaccaatcagacgtagatttggtcttttcacataatcccatatttcttggaggctttgttcatttctttttattctgttttctctgaacttcccttcacacttcatttcattcatttcgtcttccatcactgataccctttcttccaggtgatcgcatcggctcctgaggcttgtgagttcttcacataattctggagccttggctttcagctccatcagctcctttaaggacttctctgcataggttattctaagtatccattcgtctaatttttttttcaaagtttttaacttctatgccattggtttgaatttcctcctttagctcggagtagcttgattatctgaagtcttcttctctcaactcgtcaaagtcattccccatccagcttttttccattgctggtgaggagctgagttcctttggaggaggagaggtgctctgctttttagagtttccagtttttctgctctgttttttccccatttttgtggttttatctacttttggtctttggtgatggtgacatacaggtgggtttttggtgcggatgtcctttgtgtttgttagttttccttctaacagacagaaccctcagctgcaggtctgttggagtttgctggaggtccactccagaccctgtttgcctgggtatcagcagtggtggctgcagaacagcggtggctgtacaacagtggatattggtgaactgcaaatgctgctgcctgattgttcctctggaagttttttctcagaggagtacccagccgtgtgaggtgtcagtttgcccctactggtgggtgcctcccagttaggctgcttgggggtcaggggtcagggacccacttgaggaggcagtctgcctgttctcagatctccagctgcatgctgggcaaaccattcctctcttcaaagctgtcagacagggacatttaagtttgcagaggttactgctgtctttttgtttatctatgccctgcccccagaggtggagcctacagaggcaggaaggcctcctggagctgtggtgggctccacccagtttgagcttccaggctgctttgtttacctaatcaagcctgggcaatggcaggcgcccatcctccagcctcactgccaccttggagtttgatctcagaacactgtgctagcaatcagcgagactccgtgggcataggaccctccgagccatgtgcgggatataatctcctggtgtgcccttttataagcctgttggaaaagcgcagtattagggtggaagtgacccgattttccaggtgctgtctgtcacccctttctttgagtaggaaagggacctccctgaccccttgtgcttcacgagtgaggcaatgcctcgccctgcttcggctcacgcatggtgtgctgcacccactgtcctgctcccactgtctggcactccctagtgagatgaacccggtacctcagatggaaatgcagaaatcacccgtcttatgtgtcgctcatgctgggagctgtagaccggagcttttcctattcggccatcttggctccacccaaccaatacaatcttctcttttagttatttttaactgcacattacttttatttattctcactctgtcacccagactgagtgcagtggcatgatcatggcttactgcagccttgacctcccaggcttaagtgatcctcccacctcagcctcccatgtatctgagactacgggtgcatgccactacatgcagttaatttttattttattttattttattttttgtagagacaagttctctctatgttgcccaggctggtcttgaacttccagactcaagctgtcctcctgccttggccttccaatgtgctgggattacagacaagagccgtgacacctggcatgtataataaactttcgttgactgtagttatcctgttgtgatatcaaataccagatcttatctactctattttttggtacccattaaccattcacactccccctacccccactacccttcccagactgtggtaaacattgttctactctctatctccatgagttcaagtgttttaatttttagctcccataaatatgtgaagctgcctttctgtttcaggcttatttcacataatataatgtccttcagtttcatccatgttgttgcaaatgacaggatctcattcttttttatgactgaatagtactccactgtgtatatgtactacattttctttacccatccatctattgatggatacataggttgcatccaaatcttggctattgtaagtagggctgcaataaacatggggatgcagatatgtcttcaatatgctgatgtcctttctttggggcatatacccagcagtgggattgctgggttgtatggtagctctatttttagttgtctgaggaacctccaaactgttctccatagtggttgtactaatgtaccttaccaccaacagtgtattaaggttctggtgctttattcagttcatttggtgaattaatgttttcttggatgttcttgatgcttgtggatgttcctcagtgtctgagcattgaagagttaggtatttattgtagtcttcacagtctgggcttggtacccatccttcctgggtaggctttccaggtattcaaagggatttaggtgttgttctaaacctttggtcactgcagctttgtctctattaggggacaccctaagtctagtaatgttatggctcttgtagactctgaggtactgccttggtggtcttgggtaagatcatggaggaattacctggattacctcacagaggttcttgttttctttccttactttaccccaaaccaattgagtctctgtgctgagctgcctggagctgggtgtgggatgacacaagtacctctatggtactcaccactgggactgtgctgggtcagacccaaagtcagcatgccacttggtcttgcccaataccacagtgaccactgcctggctactgcctatgttcacttaaagccaaaatgctctacagtcaataggtggtgaagccagtcagtcttgtgttcttcccttaagggcagcaagttctcccttgccctgggtgggtcaaaagttgctcttctggacctaggacctggagttcagaaccttaggaatctacctggtgctctgttaaactgtggctgagccggcaagaagctgcaagacaaagtccttctcacacttgcctcccctatcctcaagtagaggagtttctccccatagccaccaccaccccaggcccacagcaagcactggctggttaccactgatgattatgcagagcccaagagcttttttgttagcaggtgatagatcctgccaggagttggtccttcccttcaaggtagcatgttcccttctagtccacagtgtgttaagaaatgtcatctgtgagctggggcttgtaatgggagccttgggactattcctgttgccttatcctactgtggctgggctggtacccaattgcaagacacagtcctcttcactccccactctcctctcgtctcttcaaggtgaaggtaggagtctctcctggagctgcaagttgtgatgcctgggtttgagggaagggtgacatgagcactccctaggctgccctagctggtgcatcactacattgtctacactccaagtctacctggctttgagcccagcatagtaccaggactcacgtaggaattggagtccttgtggctgagactgtctttcaagtttatttagggccccatagcactttagcctgcagtggcagggcttgctggaactcaggtgtcgactgctgggatggacaattcatctctgactatggctggtctaaatgctccctccgtgggtgctggttgagttctgccctgtgttgcttttgactatggtagggcagcactgagtttgaatgtgtagtcccaaaatttcagcactttcctttccctaagtacagagattctctctgttccatgtagccactgctgggggatacgagtggggtggtgtaggctatttaagaaagactgtgtttcctaccctcttcattgcctttttccttaatatggtgttaaagcaagtactgtgaccactcccttgatatttggttcttttgaaggtgctttatttatgttcaatatggtgttcctgtgtggtagggggaaacttgctgtagccttctatttagtcatcttgccctgcctccctgtcctagtattcgttgttttgagaagcctacattgatacttgttatcacttggcattttgatcatattcatactaacagatgtgaagtgatatctcactgtggttttaatttgcattcccctgatgattaattatgttaagcaccttttcatctacctgggagaccctaagtagccaaagacataataagaaaagacaacagatctggaggcatcacactgcctaatttccaagtatattataaagatatagtaatcaatagagaattgtactggcataaaaacagatacatcaaccaactgaacaaaatagatagttcacaaatatatccacacgtatatggtcaactaatcttcaaaaaaagcaataagaatacacaatacagaaaggatattccctccaaatctcatgttgaaatgtgattttgaatgttggaggttgggcctagtgggaggtattggaccatgggggcagatttctcatgaatggcttagtgccatccccttggtgatgagtagattctagctctatttatggaagatctgtttttttaaaaacagtatggaatcacccccttgtctctcttggtccttctcttgccatgtgatatgcttgcccctgctttgccttctgctgtgagtaaaagttctctgaggcctcaccagaagggaaggagatgctggtgtcacacttttgtacagtctgcagaactgtgagccaattaaaaaacctcttttctttataaattacccagcctcaggtatttctttataacaatgcaaaaatgggctaacacagggtgtctctattttattccattggtctatatttttgtctttatgccagtatcatactgttttggttcttgtagctttatagtaagttttgaaactaggaagtgtgattctgctaacttttcctctttttcaaaattgttttggctttttggggttcctttaccatctatataaattttaggatgaagttgtctatttctgccataaacattactggaattttgataggaattgcattcaatttgaaagaattgcattgggtagtatggacatcttaaaaatatgaagtcctaaaatccattaacacaggatgtctttccatttatttgtgtaattatctaatttctttcagcaatattgtataatttttagtatataggtttttcatttctttgtttaaatttatgcctaagtattttttatttgatgctattataaatagaattgtttttcttaattccttttacaaattgatgattctcagtgtgtagaaacacgactgatttttgcatgttgcttttgtaccttgcaatttggttgaattcatttacttagttctaagtgtgtgtgtgtgggggcatgtgtgtgtttatttgttaggcatttctacatataaaattatgtaatttttgagtaattttacttatttctttctgctttggatgagttttatttctttttcttccctaattgctctgggtagaacttccaacagcatattgaatagaagtaggaaaagtgggaacccataccttgtttctgattttagaggaaaagtttgcagtttttcaccactggctatgatgttagctgtgtgcttttcacatatggcttttattatcttgaaataatttccttctagcctcagtttgttgaaggatttttaaatataaaacagtattaaggggggtggagccaagatggccgaataggaacagctcaagtctacagctcccagtgtgagcgacacagaagacaggtgatttctgcatttccaactgaggtaccaggtttatctcactggggagtgtcagaaagtgggtgcaggagagtgggtgcagtgcaccgagtgtgaaccaaagcagggcaaggcatcacctcacctgggaagtgcaaggggtcagggaattcccttttctagtcaaagaaaggggtaaaagacggcacctggaaaatcgagtcactcccaccctaaaactgcacttttccaatgggcttaaaaaacggcaaaccaggagattatatcccacacctggctcagagggtcctacacccacggagtctcactgattgctagcacagcagtctgagatcaaactgcaaggcggcagcgaggccggggggaaggatgcccaccattgccctgaggcttgagtaggtaaacaaagcggctgggaagctcaaactgggtggagcccaccacagctcaaggaggactgcctgcctctataggctccacctctgggggtagggcatagccaaaaaaaaggcagcagaatcctctgcagacttaaatgtccctgtctgacagctttgaagagagtagtggttctcccagcatgcagcttgagatctgagaatggacagactgcctcctcaagtgggtccctgacccccgagtagcctaactggcaggcacccgccagtaggggcagactgacacttcacacggctgggtactcttctgagaccaaacctccagaggaacgatcaggcagcaacacttgctgctcaccaatatccgctgttctgcagcctctgctgctgatgcccaggcaaacagggtctgcagtggacctccagaaaacaccaacagacatgcagctgagggtccttactgttagaaggaaaactaacaaacagaaaggacatccacaccaaaaacccatctgtacgtcaccatcaccaaagaccaaaggtagataaaaccacaaagatggggaaaagacagaacagaaaaactggaaactctaaaaatcagagtgcctatcctcctccaaaggaacgcagctcctcaccagcaatggaacaaagctggatggagaatgactttgatgagttgagagaagaaggcttcagatgatcaaactactccgagctaaaggaggaagtttgaacccatggcaaagaagttaaaaaacttgaaaaaaaattagacgaatggctagctagaataaccaacgcagacaagtccttaaggacttgatggagctgaaaactaaggcacaagaactacgtgacgaatgcacaagcctcagtagccaatgcgatcaactggaataaagggtatcagtgatggaaggtcaaaggaatgaaatgaagcaagaagagaagtttagagaaaaaagaataaaaagaaatgaagaaagcctccaagaaatatgggactatgtgaaaagactaaatctacatctgattgctgtacctgaaagtgacagggataatgaaatcaagttggaaaacactctgcaggatattatccaggagaatttccccaatctagcaaggcacgccaacattcaaattcaggaaatacagagaacaccacaaagatactcctcaagaagagcaaccccaagacacataattgtcagattcgctaaagttgaaatggaggaaaaaatgttaagggcagccagagaaaaagatcgggttacccacaaagggaagcccatcagactaacagctgatctctcggcagatattctacaagccagaagacagtggggaccaatattcaacattcttaaagaaaagaattttaaagccagaatttcatattcagccaaactaagcttcataagtgaaggagaaataaaatcctttacagacaagaaaatgttgagagattttgtcaccaccaggcctatgctaaaagagctcctgacggaagcactaaacacggaaacggaaaaccagtaccagccactgcaaaatcatgccaaattgtaaagaccatcgaggctaggaagaaactatatcaactaatgagcaaaataaccagctaacatcataatgacaggatcaaattcacacatgacaatattaaccttaaatgtcaatgggctaaatgctccaattaaaggacacagactggcaaattggatagaggcaagaccaatcagtgtgctgtattcaggagacccatctcacatgcagagacacacataggctcaaaataaagggatggaggaagatctaccaagcaaatggaaaacaaaaaaaaaaggcagggattgcaatcctagactcggataaaacacattttaaaccaacaaagatcaaaagagacaaagaaggccattgcataatggtaaagggatcaattcaacaagaagagctaactatcctaaatatatatgtacccaatacaggagcacccagattcataaagcaagtccttagagacctacaaagagacttagacaccccacacaataataatgggagactttaacatcccactgtcaacattagacagatcaacgagacagaaagttaacaaggatatccacgaattgaactcagctctgcaccaagtggacctaatagacatctacagaactctccaccccaaatcaaaacaatatacatttttttcagcaccacaagacacctattccaaaaatgaccacatagttggaagtaaagcactcctcagcaaatgtaaaagaacagaaattatagcaaactgtctctcagaccacagtgcaatcaaactagaactcaggattaagaaactcactcaaaaccgctcaactacatggaaactgaactacctgcttctgaatgcctactgggtacataatgaaatgaagacagaaataaagatgttctttgaaaccaacgagaacaaagacacaacttaccagaatctctgggacacattcaaagcagtgtgtagagggaaacttatagcagtaaatgcccacaagagaaagcaggaaagatccaagattgacactctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggatcttgttttttgaaaagatcaacaaaattgatagaccgctagcaagactaataaagaaaaaaagagagaagaatcaaatagatgcaataaaaaatgctacaggggatatcaccaccgatcccacagaaacacaaactactatcacagaatactataaacacctctacacaaataaactagaaaatctagaagagatggataaattcctggacacatacaccctcccaagactaaaccaggaagaagttgaatctccatatagaccaataacaggctctgaaattgaggcaataactattagcttaccagcaaaaaaaagtccaggaccagacggattcacagccgaattctaccagaggtacaaggaggagctggtaccattccttctgaacctattccaatcaatagaaaaagagggaatcctccctaactcattttatgaggccagcatcattctgataccaaaacctggcaaagacacaacaaaaaaagaaaatttcaggccaatatccctgatgaacattgatgcgaaattcctcaataaaatactggcaaaccgaatccagcagcacatccaaaagcttatccaccacaatcaagtcggcttcaccccggggatgcaaggctgtttcaatgtacacaaatcaataaacgtaatccatcagataaacagaaccaatgacaaaaaccacatgattatctcaatagatgcagaaaaggccttcgacaaaatgcaacagcgcttcatgtgaaaaactttcaataaactggatatcgatggaatgtatttcaaaataataagagcaatttatgacaaatccacagccaatatcatatggaatgggcaaaaactggatgcattccatttgaaaactggcacaagacaaggatgccctctctcgccacaattattcagcatagtattggaagttctggccagggcaatcaggcaaaagaaagaaataaagagtattcaattaggataagaggaagtcaaatcgtccctgtttgcagatgacatgattgtgtatttagaaaaccccatcatctcagcccaaaatctccttaagctgataagcaacttcagcaaagtctcaggatacaaaatcaatgtgccaaaatcacaagcattcctatatatcaataacagaaaaacagagagccaaatcatgagtgaactcccattcacaattgctacaaagagaataaaatacaactcacaagggatgtgatggaccttttcaaggagaactacaaaccaccactcaaggaaataagagaggacataaacaaatggaagaaccttccatgctcatggataggaataaccaatatcttgaaaatggccatactgcccaaagtagtttatagattcaatgctatgctcatcaagctaccattgactttcttcacagagttggaaaaaactactttaaagttcatatggaaccaaaaaagagcccacatagccaagacaatcctaagcaaaaagaacaaagctggaggcatcacgctacctgacttcaagcaatactacaagactacagtaacaaaagcagcatggcactggtgccaaaacagatatatagaccaatgaaacagaacagaggcctcagaaataatgccacacatccacaaccatctgatctttgacaagcctgacaaaaacaagaaatggggaaaggattccctatttaataaatggtgttggacaaacgggctagccacatggagaaaactgaaactgggtcccttccttacaccttatacaaaaattaactcaagatgggttaaagacttaaacataaaacctaaaaccataaaaaccctagaggaaaacctaggcaataccattcaggacataggcatgggcaaagacttcatgactaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaatctctctatctgacgaaggactaatatccagaatctacaaagaacttaaacaaatttacaagaaaaaaacaaacaaccccatcaaaaagtgggcaaaggatacgaacagacacttctcaaaagaagacatttatgcagccaaaacacatatgaaaaaatgcgcatcatcactggtcattagagaaatgcaaatcaaaaccacaatgagataccatctcacaccagttagaatggcgaccatgaaaaagtcaggaaacaataggtgctggagaggatgtggagaaataggaacacttttacacagttggtgggactgtaaactagttcaacccttgtggaagacagtgtggcgattcctcaaagatctagaactagaaatactatttgatccagcaatcccactactgggtatataccaaaaggattataaatcattctactgtaaagacacatgcacatgtatgtttattgtggcactgttcacaatagcaaagacttggaaccaacccaaatgcccatcaatgatagactggataaagaaaatgtggcatgtatacaccatggaatactaagcagccataaaaaaggatgagttcacgtccttgttagggtcatggatgaagctggaaaccatcattctcagcacactaacacaagaacagaaatccaaacaccgcatattctcactcataagtgggagttgaacaatgagaacacatggacgcagggaggggaacaacacacaccggggcctactggggggtggaggtctaggggagggatagcattaggagaaatacctaatgtagatgacgggatcatgggtgcagcaaaccaccacaggacgcgcatacctatgtagcaaacctgcactttctgcacatgtagcccagaacttaaagtataataaaaaagaagtggggtttatcctatggaaaaatgggaagtcgttactaaagagtatttagtcaggcgagtattgttatcatatttgtgcttcataaagaccactttgattacagggtggatgatgaattggaaggatgtcaatgagaatgctgctatagtggtccaggggagactgaaataaggcagtagcaatagggtttccaagaaaagaatggactccagacacacagtgaaggttagctgaaatggtcttgatgaggaagtgtgtggaaaattctatgattcccatattggttcatggcttgagtgggtggtgctggtgccatttactaaattagcaaacaggagagcagcagctttaagagaaggaatgtatgtgaaaagtgaggaaatatccaaatgaatatgtgtggattataagaataattgaagtcactagtgatgtctgaatgaatttgtgacagtaggtgggcaatggtaacaccagaatggatgtgtgcatcatctgaaagaaactataacaaatgcccattatcagatgctcatattttctcattcagttgtctcaaaatctcatttaggcattagataaacacagttgtctcatattcattcagatgtcaaaataacacattgtctgttacacccaaattcagatatagaatggcttattcattcacttctgcttttagctcagagatgtagcaggctggaaagagcattgtttccataatttcagcaagaaaaaccatacagactgcaagttaaccaatcttgaactcattagaaaacagagcaaaaagctaactcaaaatttggagagagataaaagcctatagaaagaaccagtaccacagtatctgcttacctaatgcacatgtcatcacgttatcatataagatggtagggagaattaactggaaagtttaatgaactgctaaaggcccagtatggacaagattgagaatgtgagacccctggaggcatagaaagcccacacttttagtggacttttcttcaaggaatctgacctagctcttagaagaaagattagcaagtaaccagaaaaaactccctccttgctgccgtctcggggaagggaacaagagtcactgccaaatccacccagacacacctcctttaactccattagagaagaaaaaagttaatctgcaggggaagagccatcaatagtggtatgctgagggcactgatgcaatctcattgcaactgaggagggaaacataagtcaccatcaaaactgcttagactcatctctccagttctcctaaataacaaaagctttaatatgtgagaaaggggggacatcatgacaataatttgagaactcttgtggaagctcgctgcagacagggtaagaaaatgggggaagaacaaggctctattccttggagaggtaaaggaatacttattaagccaaccattacatctaaaggagagacaggaacaattttgaaggccacatccttgagacccaggtattcagtgcctgcctagcactggggttaaatcaaaagctcaaacacactcatcttgtccacgccaaacaccaagctagcaagtatagagtaacaataatagtggaatacagctggcagtactgcaaaatgcagattcattatgaggagcagcacaagagctgagaaagaaaggatattactagaggaatattaaggccctggtaccaatagcaacaacaaaaaaattaaactgtggtaaccaaagcaacaataatatttaactctggtaaacatcacaacaacaaacttaaactgtagtccaactcttgactacattaacacaaacttacacagtaaaggcctagaagagggaaagcctggccataactgagcataaaaatatttacttcaggggaggttccaagatggccgaataggaacagctccagtctacagctcccagtgtgagtgacacagaagatgggtgatttctgcatttccaactgagtaccgggttcatctcactggggcttgtcagacagtgggtgcaggacagtgagtgtagcccgccaagcatgagccgaagcagggcgaggcattgcctcacctgggaagcacaaggggtcaagaaattccctttcctagccaagggaatctgtgacagatggcacctggaaaattgggtcactcccagcctaatactgtccttttccaatggtcttagcaaacagaacaccaggggattatatcccatgcctggctcagagggtcccacacccatggagccttgctcactgctagcgcagcagtctgagattgaacttcaaggtggcagcgaggcagggcaaggggcgtctgccattgttgaggcttgagtaggtaaacaaagcggcccggaagctcgaactgggtggagcccacaacagctcaaggaggcctgcctgcctctgtagactccacatctgggggcagggcatagctgaaaaaaaggcagcagaaacttctgcagacttaaacgtccctgtctgatagctttgaagagagtagtggttctcccagcacggagtttgagatctgagaatggacagactgcctccccaagtgggtccctgatccccaagtagcctaactgggaggcatctcccagtacaggctgactgataccccatatggccgggtacccctctgagatgaagcttccagatgaatgatcagacagcaatatttgccattccgcaatatttgctcttttgcagcctccactggtgatacccaggcaaacaggttctggagtggacctccagcaaactccaacagacctgcagctgagggtcctgactgttagaaggaaaactaacaaacagaaaggacatccgcaccaaaaccccatctgtacgtcaccatcatcaaagaccaaaggtagataaaaccacaaagatggggagaaaccagagcagaaaagctgaaaattctaaaaatcagagcacctctcccccttcaaaggaatgcagctcctcgccagcaacagaacaacgctggacggacaatgactttgatgagttgagagaagaaactttcagacgatcggtaataacaaacttctccaagctaaaggaggatgttggaacccatagcaaagaagctaaaaaccttgaaaaaagattagacaaacggctaactagaataaacagcatagagaagactttaaatgacctgttggagctgaaaaacatggcacgagaactatgtgatgaatgcacaagcttcagtagacgattcaatcaactggaaggaagggtatcagtgattgaagatcaaatgaatgaaattaagtgagaagagaagtttagagaaaaaaaaaagtaaaaagaaacaaacaaagcctccaagaaatatgggactatgttaaaagaccaaatctatgtctgactggtgtacctgaaactgacggggagaatggaaccaagttggaaaacactctgcaggatattatccaggagaacttctccaatctagcaaggcaggccaacattcaaattcaggaaatacagagaacgccacaaagatactccccgagaagagcaactcgaagacacgtaattgtcagattcaccaaacttggaatgaaggaaaaaatgtcaagggcagccagagaaaaaggacgggttacccacaaagggaagcccatcagactaacacctgatctctcagcagaaactctacaagccaaaagagagtagaggccaatattcaacattcttaaagaaaagaattttcaacccagaatttcatatccagccaaactaagcttcacaagtgaaggagaaataaaatcctttacagacaagcaaatgctgagagatattgtcaacacaggcctgccttacaagagctgctgaaggaagcactaaacatggaaaggaccaaccagtaccagccactgcaaaaacatgccaaattgtaaagaccgtcgaggctaggaagaaactgcatcaactaaagagaaaaataatcagctaacatcataatgacaggatcaaattcacacataacaatattaactttaaatgtaaatggactaaatgctccaattaaaagacacagactggcaaattggataaagagtcaagacccatcagtgtgctgtattcaggagacccatctcacgtgcagagacacacataggctcaaaataaagggatggaggaagatctaccaagcaaatggaaaacaaaaaaaggcaggggttgcaatcctagtctctgataaaacagactttaaaccaacaaaggtcaaaagagacaaagaaggccattacataatggtaaacagatcaattcaacaagaagagctaactatcctaaatatatgcactctatacaggagcacccagattcataaagcaaataaagcaagtacttagagacctacaaagagacttagactcccacacattaataatgggagactaataccccaccatcaacattagacagatcaatgagacagaaagttaacaagatatccaggaattgaaatcagctctgcaccaagcagacctaatagacatctacagaactctccaccccaaatcaccagattatatattcttctcagcaccacactgcacttattcgaaaattgaccacatagttggaagtaaagcactcctcagcaaatgtaaaggaacagaaattataacaaactatctctcagaccacagtgcagtcaaactagaactcaggattaagaaacccactcaaaaccactcaactacatggaaactgaacaacctgctcctgaatgattactgggtacataatgaaatgaacacagaaatagagatgttctttcaaaccagtgagaacaaaaacacaacaaaccagaatctctgggacacatttaaaggagtgtgtagaggggaatttatagcactaaatgaccacaagagaaagcaggaaagatctaaagttgacaccctaacatcagagataaaaaaaccagagaagcaagagcaaacacattcaaaagctaccagaaggcaagaaataactaagatcagagaagaattgaaggagatagaaaaacaaaaaacccttcaaaaaatcaatgaaaccaggagctggttttttgaaaaggtcaacaaaattgatagactgctagaaagaataataaagaagaaaagagagaagaatcaaatagatgcaataaaaaatgatgcaggggatatcaccactgatcccacagaaatacaaactgccatcagagaatactataaacatctctacacacataaactagaaaatctagaaaacatggataaattcctggacacatacaccctcccaagactaaaccaggaagaagttgaatccctgaatacatcaataacaggctctgaaattgaggcaataattaatagcttaccagccaaaaaaagtcgaggaccagacagattcacagctgaattctaccagagttacaaagaggagctgctaccattccttctgaaagtattccaatcaatagaagaagagggaatcctccctaactcattttatgaggccagcatcatcctgataccaaagcctggcagagacacaaccaaaagagagaattttagaccaatatccctgacgaacattgatgcgaaaatcctcaataaaatactggcaaactgaacccagcagcacatcaaaaagtttatccaccacgatcaagttgccttcatccctgggatgcaaggctgcttcaacatccacaaatcaataaatgtaatccatcatataaacagaaccaaagacaaaaaccacaaggttatctcaatagatgcagaaaaggcctttgacatatttcaacagcccttcatgctaaaaactctcaataaactaggtagtcatggtatgtatctcaaaataataagagctatttatgacaaacccacagccaatatcatactgaatggacaaaaactggaagcattccctttcaaaacgggcagaagacagggatgccctctctcaccacccctattcaacattgtgttggaagttccagccagggcaatcaggcaggagaaagaaataaagggtattcaattagggaaagaggaagtcaaattgtccctatttgcagatgacatgattgtatatctagaaaaccccatcgtctcagccccaaatctccctgagctgatatgcaaattcagcaaagtctcaggatacaaaatcaatgtgcaaaaatcacaagcattcttatacaccaataacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccctgctcatggataggaaggatcaatatcatgaaaatggccatactactcaaggtaatttatagattcaatgtcatccccatcaagctaccaatgacttttttcacagaattggaaaaaactactttaaagttcacatggaaccaaaaaagagcccgcattgccaagacaatcctgagccaaaagaacaaagctggaggcatcacgctacctgacttcaaactataccacaaggctacagtaaccaaaacagcatggtactggtaccaaacagagatatagaccaatgaaacagaacagagccctcagaaataataccacacatctacaaccatctgatctttgacaaacctgagaaaaacaagaaatggggaaaggattccctatttaataaatggtgctgggagaactggctagccatatgtagaaagctgaaactggatcccttccttacaccttatacaaaaattaattcaagatggatgaaagacttaaatgttagacctaaagccataaaaaccctggaagaaaacctaggcaataccattcaagacataggcacgggcaaggacttcatgtctaaaacaccaaaagcaatgggaacgaaagccaaaattgacaaatgggatctaattaaactaaagagcttctgtacagcaaaagaaactaccaaaagagtgaacaggcaacctacagaatgggagaaaacttttgcaatctacccatctgacaaatggctaatatccagaatctacaatgaacttaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggactggatgtggagaaataggaacacttttacactgttggtgggactggaaactagttcaaccattgtggaagacagtgtggcgattcccgaaggatctagaactggaaataccatttgacccagccatctcattactgggtatatacccaaaggattataaatcatgctgctataaagacacatgcacacatatgtttattgtggcactgttcacaatagcaaagacttggaaccaacccaaaagtccatcaatgatagactggattaagaaaatgtggcacatatacaccatggaatactatgcagccataaaaaagaatgagttcatgtcctttgcagggacatggatgaagctggaaaccatcattctgagccaactatcacaaggacagaaaacgaaacaccgcatgttctcactcataggtgggaattgaacaatgagaacacttggatacaggatggggaacatcacacaccagagcctgttgtggggtgggggaaggggggagggatagcattaggagatatacctaatgtaaatgatgagataatgggtgcagcacaccaacatggcacatgtatacatatgtaacaaacgtgcacattgtgcacatgtaccctagaacttaaagtataataataaaaaaaaataaggctgtctcttaaaaaaataaataaaatttaaaaatagattaaaaaatatatttatttcagtatctactaacctatacaacacgtgcagattgcaacaaatattataaggcataaagtgaggcaacagaaattaagcctgaagagagacaaagcaatcctaaaagcaagttcagatgtgatttagacgttggaaatatcaggcagggaattcaaaacaactacaattagtgtgttaaagtttccattggaaaaggtacgcaacatgaaagatcagataggcaattaagcagacagaggcaaattataaaaaataataaagagatattacaaataaaacatacagtaacagaaatgaagaatgccttcaacaggatcagcagtaaactcaaaacagctatgaaagaaccagtgaacttcaatataggtcaaaaaattatctactttcaaataccaaaaaaaaaaaagtgaagaaaacagaatagggcatccaagagctataggacaatatcaaacaatttaatatatgtgcacttccataaatagaagaaatagagagtggatcagaatacatatttgaagaaataatggccaagagttatctgaaattagtgacagacaccaagccacagatccaagaaggcagagagcatcaagcagtataaataccaacacagacacacacacacacacacacacacacacacacacacacacatgcatgcacacaactaggcatatagtattcaaaattctgaaaaccaaaggaaaagagaacatcttgaagatagtcataggaaaaaaaagacatattacccacaaaggagaaatgataagatttacagcagaattatcattggaaaaaatgcaaacaagaaggcaattgactgacatcttccatgagttggaaaaaaaattgccaatcaagtatgctttacccagcaaaactatgcttcaaaaatgaaggctgggtggtagagccaagacggttgactagacacagccaggaagagcttcccccactgagagattagaccatcaaaaagacaagcacactccaagcagatcttctgaagtaaggcattgatggtggatagagggaggatgcagaccctggggtaaagggagaggaaactgggaactctgcatgaggttgccaaacactaggactcattcctggcctcaagtggctcctggggaagaggtgagtaggcatggggtggcctactttcaccataaactttatgaatactagctgcaggagatctcatgacctccacggacatttgagctgtcagggagagctgcttggagagctagccaggatgggactccagcctgcatggagcccagagggtttagcataggaatggctgcagtggagcatagccagtgatgtccatttaccaaggcttaccatcctcctctgggtggctttggcctttgttgactgtcaagtatggacagaacagggctatcttgcctgtgaaatggatccagtcagatttgagcaggccactctttgctggcctctctcagagtaccttcctggccatgcccacttgaagcacagtctcagatgttcaactggggagcatcctggtggctaataccataactccttcattggcagatcccacctaaccattgcagagcttctgcagatgatcccctataagcatgcacccacccacaggcttcccccactgccttgccagcatgtacttggccacaccctctgcctaccactttgctggcaggtataagcatgtgaactttgctgcctagccactgccagcacaagtgcatatacatggttcctgcttctgcaccacatgtgctggtgcacgcacatgtggacgccactgccttacgcccaccctgccagcactgttatgcatatgccagcatgggccttgccacctctataaaatgattttgcctgcatcccccatcagagtgttgttgccagtggatcagaaacatcttggctcctccaatgcaacagatgcttaattttgaggggccagataacaaagccatgggcctgggcccagtcctctagtgttacagcatgcagcccaggagtgccgagctgagtcttggccctctgaaatcatccagaaatgaagctagtggactgaatccaacttatactaaagtcaagcccttaaggacatcaaagaatataaaagcaaaaagccccatgcaaaagacagcaacttcaaagactaaaagaacatcagatgagaaagagctgacataagaatctggcatctcaaaaaaccagagtgtcttcttacctccaaatgaccacactagctctggagtcatggttcttatccaggctgaaatggcagaaatgaaaagcatagaattcagaatctggatggcaatgaagatcatcgacattcaaaagaaacttgaaacccaatccaaggaatccaaggaacccagtaaaatgatacaagaactgaaaggtgaaagaagcattttaagaaagaagcaaactgatctgatagagatgaaaagtttactacaagaattttgtaatacaatcagaagtattaacaacaaaataaaccaaactgaagaatctcagagctcaaagaccagttcttcaaattgacttagacaaaaatacagcaaaaagaataaaaaagaatgagcaaaagagaccaaacctatgacttatttgtgtccatgaaagaaagggaaagagaacaagcaacttggaaaacttagctgaggatattatccatgaaaatttccccaacctcactagagaggtcaacattcaaattcaggaaatgtagagaaaccctgcaagatactatacaagacaaccatccccaagacacgtaatcatcagattctccaagataaacatgaaagaaaaaatcttaaaggcagctagaaagaaggggcaggtcatctacaaagggagccctgtcagactaacagcagaactttcagcagaaactccacaagccaggagagcttgggggcctatattcatcattcttaaagaaacaaaattccagtcaagaattttatatccagctaaactaagcttcataagtgtaggagaaataaaataaaatccttttcagacaagcaaatgcaaagggaattcattaccaccagacctgcctcacaaaaggtcctttaagggagtgctaaatatggaaatgaaagactcttaccagccaaaacagaaacatgctttagtatataaatcattgacactaataaaacaatgacacaatcaagttgtaaaccaaaaataaaattcgaagccccccgccccactcccccacacccctgcctcctgcaaccatctgaatggactcccttattagctagggcactctaaaatttaatctgaaagactggttcaggtcatgatggaaagtgggtattggacgtgcctattatacccctccagcattaacatcaacacagaccttaagtctgatcagaaatacttacaatctattttctctgaagcctgctgcctgaagcttcatctgcatgataaaaccttggtctccacaaccccttatcttaacccagatatttctttctactgataataactcttaaccaattaccaatcagaatatgtttaaatctacttttgacctggaatactgctcccctcccacccacacccctgcttcgagttgtctcacccttctagattgaaccaatgtaagtcttatatatagagattgatgtattatgtccccctaaaatgtatacaagcaagctgtgccccaatcaacttggcacatgtcatcaggacctcctgaggctgtgtcataattgcattcttaaccttggcaaaataaactttctatattgactgagacctgtctcagatactttgggttcacaaagtttacagaacattcagctaacagcacaattaacaggatgaaatcagcacatatcaatattaaccttgaaagtaaatgggttaaacactccacttaaaaggcacagagtagcaaattgtatgaagatgcaagatcaaactctatggtacctttaagagacccatttcacatgcaatgatacccacaggctcaaagtaaagggatagggaaagatctattaagaaaatggaaaagaaaaaaagcaagggttgcctttcttatttcagacaaaacagactttaagccaacaattatttaaaaaaaaataaacaaggacattacataatgaaagatggtttcattcaacaagaagatttaagtatcctaaatatacatgcacacaacactggagcactcagattcataaaacaagttattagagagttatgaagaaactagaataaccacacagtaatataatagtgggagacttcaacaccccactgacagtattatagagatcattgaggcagaaaactaacaaagatatttgggacctaaattcaacacttgatcaaatgtacctaacatatatctacagactctatccaacaacattcttcttatctgcacatggcacacactctaaaattgaccacacacttggccataaagtaattctcaaaaaattcaaataaactgaaatttcagcaaccacatgctcggatcatggcacaatacaaatagaaatcaatgctaagaaaatctctcaaaaccatataacaacatgaaaattaaacaatctgctcctgaatgacttttgataaacaatgaaattaaggcagaaatcaagaaattctttgaaattaatgaaaacaaagctacaacataccagaaactctgggacacagctaaagcagtattaagagggaacttcttagtgctaaatgcccacgtcaataatttggaacgatctcaaattaacaatctcatatcacacctacaggaactagaaaaacaagagcaagccaaccccaaagctagcggaaaataagaaataaccgaaatctgatcttaactgaataaaatggggacaggaaaaaaccacataaaagatcaataaaagcaaaagtttgttctttgaaaaaaataagactgatagaccactagctagactaataaagaaaaaaggagagaagatccaaataaacacacccagaaatgactcagtggacattaccactaaccccagagaaatacaaaaaaccctcagagactattatgaatatttctatgcacacaaactagaaagccgacaagaaatagataaattctaggaaatatacaaccctccaaggttgaatgaggaagtaattgaaaccctgaacaggccaataatcagttctgaaatttagtcagtaataaaaggcctaccaacccgaaaaagccctgggacagatggattcacagctgagttctatcagacctatgaagaagagatggtaccaatctttctgaaactactcccaaaaatcgagtaggagagactcctccataactcattctatgagcccagcatcattctgataccaaaatctggcagagacacaacaaaaaaagaaaacttcaggccaatatttcttatgaacatagatgcaactctcaacaaaatactagcaaaccaaatctggcagcacattaaaaagctaatccaccaaaatcaactagattttattcctgggatccaaggttggttcaatatacacaaatcaataaatgtgattcatcacataaacaaaaaccacatgcatgataatctcgatggatgcagaaaggcttttttttttttttttttttttttgagatggagtcttgctctgtcacccaggctggagtgcagtggcgcaatctcggctcactgcaagctccgcctccgggttcacgccattctcctgtctcagcctcccgagtagctgggactacaggcgcctgccaccacgcccagctaattttttgtattttttttagtagagacggcgtttcaccatgttagccaggatggtctcgatctcctgacctcgtgatccgcccgcctcggcctcccaaagtgctgggattacaggcgtgagccaccgtgcccagccagaaaggcttttaataaaattctgcatcccttcatgttaattatcctcaataaactaggcatcaaataaacatatctcaaaactatgacaaacccacgaccaacaagatactgaatgggcaaaaactggaagcattcctcttaagaaccagaacaagacaaggatatccattctcaccacttctagccaacatagtactagaagtcctagccagagcaatcagacaagagaaagaaataaaaggcatccaaataggtagagaggaagtcaaactgtccctgtttacagatgatataattctctacctagaaaacccaatagtctctgcccagaagctcctagatctgatgaacaatgtcagaaaagtttcaagatacaaaatcaatgtacaaaaatctgcaacatttttatactccaacaacatccaagctgagaaccaaatcaagaacacaaccccattcacaatagccataaaaacaacaaaatgcatagaaatacagctagccatggagatgaaagatctccacaatgagaattacaaaacactgaagaaagaaatcagagatgacacaaatggagaaatattccatgcttatggattagaagattcaatattgttaaatttgccatattgccccaagcaatttgcaggttcagtgctattgctatcaaactgccaatgacattttgcacttaattaggaaaaaatgattctaaaattcatatggaaccaaaaaagagccaattagtcctaagcaaaaagagcaatgttacaggcatcacaccacccaacctcaaactatactacgaggctacagtaaccaaaacagcatgtttctggtccaaaacagacacatagatcaatggaataggtcagagaacgaaaaaatacacctgcatacctacaaccatctgatctttgacaaagctgacaaaaatgaacaatggggaaaagactccctattcaacaaatggtgctgggataactggccagccacatgcagatgattgaaactaaactccaacctttcaccatatacaaaaatcaagtcaacatggattaaagacttccatgtaaaaccgaaaattataataaccctggaaaaaaaacctaggaaataccattctgaacataggctctggcaaagatttcataatgaagactccaaaaacaatgctatataaacaaaaaattgacaagtgggacctaattaaagagctttcacacagcaaaggaaactatcaacagagttaacagacaacctacagaatggtagaaaatatatgcaatctatgcatctgactataatgttcaatatacagaatctatatgtaacttaaaaaaattagcaagtaaaaacaaccccattataaaataggcaaaggacatgaacagatacttctcaaaagaagacaaacacacggccaaaaaacatatgaaaaaatgctccacagcactaataattagagaaatgcaaatcgaaatcacaatgagatactatctcataccaggcacaatggttactatttaaaagtccaaaaactactgatgctggccaagcttcagaaaaaaaggaatgcttatacactgttggtgggtatgtaaattagcttagccactgaggaaagcagtttggagatttctcaaataacttagaactaccattcaacccagcaattccattactggctatatatccaaaagaatataaattgttctaccataaagacacatgcatgtgtatgttcattgcagcactattcacagtagcaaagatatggaagcaacgtaaagcccatcaaaggtggactggataaacaaaatgtggtacatgtatatgatggaatgctacacagtcataaaaaagtgaaatcatgtcctttgtagcagcatggatgcagctggaggccattatcctaggtgaattaatgcaagaacagggaataaaatatcatacattctcactcataagtgggagctaaacattgagtacacacggaaacaaagaaggaaacaatacatgctggggcctacttgagggtgaatggtgggaggaggttgaggatcaaaaaactacctattgggtactatgctaaaaaaaaagttggctgtgaaatcctccacaaataaaagtataccccatgcgtacacacacaaatgaagactggacttcaattttcagctcaaacatggaaggagatagaaagaggtaagacttatactcacaataaaaaaacagctggacagacagtatattaattttgttatctgattccaacatggatctgggttcacaaaaataacagccttcctgaaattttgagacagacacacaatgccttgagcatcttattacctagggaagaaggtgttgaatttcatgtaagctggtatgaagattaaaatagaaattttagtaaagtgttggagaccaaatatagcctacaaatatagctagaaagtgtgaattcctggaggccacactcatagagggggacaccactcttatgcaggcttttaaaggaactccaccaggctctcaaagtgagaataaagaagaacctagaaaaattacctccctctcccatagtgatgactggggcaacggaacatcaagccactgggatatcttctcagacgcttttaccttatagaaaaaaattcctaattagcagggtgcagaatatcactgggggcactagtgaaataccactgcagctggagaaatgctcagatcccatccacaacctcacctacgtcaaaaaataacaaaaaagtcttaatctgcagaaggaaggtcctcaagttgaagacacagaatattggctgatatccacggcagctcagggaattgagtgaggatggtgaaagctctagccatccaggagtgatagaaaagcctgtaagggccacaccctgagagacaggcccgctgtgtactccaaagactaagacataataagaacattatgtctctatctccacagtaaaaaaagaaagaaagaaaagtcatatccttcgcccactttttgatggggttgtttgtttttttcttgtaaatttgatggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagatgtaaggaagggatccagtttcagctttctacatatggctagccagttctcccagcaccatttattaaatagggaatcctttccccattgcttgtttttctcaggtttgtcaagatcagatagttgtagttatgcagcgttattaaatgtggcacatatacaccatggaatactatgcagccataaaaaatgatgagttcatgccctttgtagggacgtggatgaaattggaaatcatcattctcagtaaactgtcgcaagaacaaaaaaccaaacactgcatattctcactcataggtgggaattgaacaatgagatcacatggacacaggaaggggaacatcacactctggggactgttgtggggtggggggaggggggagggatagcactgggcgatatacctaatgctagatgacgagttagtgggtgcagcgcaacagcatggcacatgtatacatatgtaactaacctgcacaatgtgcacatgtaccctaaaacttaaagtataataataaaataaaaaaagaaaaaaaaagaaaaaaaagaaaaataaaaaaacagaaaaaaaaaacacagtctgatgagacaaacaagtaatcagaaccaaactcagcaatgatacatatgttggaactatcatacggggaatttaaaataactatgattaatatgttaaaacctctaatagaaaaggtagaccacatgcaagagtagtagataggtgatttcagtaaagaaattgaaaccataaatgtgaaaccaagaaaaatagtagaaataagaaatatgataacaaatatgaaaaatgtcttttagaggatcatcactgatttacagagcaaagggataaattagtgaacttgaaaatagaactatggaagttacacaaagagtgtaaaaagcagaacagaaaatctaagagatgtggggtaatagcaaatgatgtaacacataagtaattggaatcacagaaataaaaataagacagagaaaatatttgaaaaaacagtgggtgtttttttccagtattagtgatagacatgaaaccaaagatccaagaagctcagagaacaccagacagagtaaaataaaaataaaataaaaccaaataaataaaaaccaaataaaaacacacactcacacaccactaggcatatcaaaatataactcctgaaaaacaaagacaaagggaaaatcttgaaggcaaccagagaaaatgaacaacttacctataaagaaacaagattaagagttcgagtaaattctcgtcacaaaatgtgttatggattgaactgtgtccctccaaaagatatctgatgttcttacccctagtacctatggatagatgtgaccttatttgcaaatagagtctttgtggatgcaatcatgttaatatgaggtcatactcaattaaagtgggctccaattcaatttgactgttgcctttaaaagaagagaaaatgtgtagcactgaaggtatacattggaaaagaaaaaatatacctaaaatctgtttattaagatcccaccctagtacagaaagaagagaaaatttaacttaaacagaagggataaaataataaaaaatagagcagaaatcaatgaaattgcaaatgggaaaacaaagaaaatcaatgaaagcaaaagttggttagtgaaaagattaataaagttgataaacctctagccaaagagaatgagagagagaaaacacttattaccaatatcaggaataaaagtaagggaatgattactgatcacacagctgttaaacagatgataaggaaaaacaatgaacaagtttgtgccattcaattttaaaattttggcaaattaaaccaattcctcagggaaaaaaaaacacttactaccaaaacgtactaaagaagagaaagagataatctgaacatccctggacctattaaattgaatttatagtaaaagcaaacaaacaaaattaaaaatcttccaaaaaaacctatttcaggcccagatggtttcactggtgagttttaccaaaacttgaaaaaagaaacaacatcaattctccacattttctcccagaaaacagaaaaggagagaacacctctcaacatattttatgaggccagcattagcctaatattaaagccatacaaaaacattataagtaaactgtagatcaatatctctcataaatacagtcataaaaatccttaacaaaatattagcaaaaagaattcatcaatatataaaaaaggataaaatatcatcataagcaggtttgtcccagtaatccaagtggattaaatagtaaaaaaaatcaatgtaattcaccatactaatgactaaatttttaaaatcatataatcacatcagtagatgcggaagaaaatcttttgagaaaatttgatacccattcattataaaaattctttgtaaactagaaatggaagataacttcctcaatctgataaaggcaatctatgcaaaatctacaggtgatatattaatggtgagacacaacattttccttgtatgatttatagtaagacaaggatggcctcactaacaactcctgttcaactttgtgctggaattcctagctaatgatatgagtcatgaaaaagaaataaaagacaggcaatgtggaaataaataaaattatatttgttctctgataaactaatttttttaatgtgaaaataccaatgtctacaaaaagtgctgctgaaatttataagtttagcaaagatccaaaataccagattaacctacaaaagtcaattgtgatcctatatactatcaataaacaattggaatctgaaatttaaaatcaaccctatttacaatagcaccaaataatgaaggacttaaatataaatataataaaatatatgcaaaatctgtatgcagaaagtataaaacaatgatgagagaaataaaagaagatataaatgaatgagacatactatgttgactaatttgaagactcaccatttttaaaatgtaaattctccccaactttatctatagatgtaatgtaatctcaatcaaaattcaagaaagcaattttatagacattgaaaactttattctataatgtatatggaaaggaaaaaggaacataaggaactagcaaaaaatatctttgaaaaagattaacaaagttggaggactcacattacctgatcctaagactttttataaggctacagtaatcaagccagttttttactggcatagacacatagatcaaaggaacagaatagagagcccagaaatagaccctaatatataacattgactaatgttgacaagttttaaacaaatttaatgaaaaaacaaagataattttttcaacaaattgtactggaacaactggacaattgaacactcatacataacaaaaaataaaattaacaccttatgcaaaaattaactcataattgatcatagaactcattataagttataaaactataaaaattttagaagaaaatataacagtagatatgcttaacttagacattagcaatgaaatttcagatatgatactaatatcaaggtccatgaaataaaaaaagaatagattgaactttgttgaaaattttaaaacctgatgtgtaaaagacactttaagagaatgaaaagataaggcacacattgggaagaaatatttacaagtgatatatccaataaattacttatatcaaaaatatataaagaacatcaaaaactcaataataagaaatcaaacaacccaattaaaaaatagggaaaacaggagatggacatcagcaagatggcagaataggactcaacaatgcttgacccctttcagaaacatcaatttgaacaactatccatgcatgaaaataccttcataagagctaaggaaacaaggtgagagattatagcacctggatatagcgctgaaataagaaaagatgcattgaagagggtaggaaaaataattttacattaccccttccccaactgcagacagcacagcatggagaaacaaccttcatgtgggggaaagagaaggaactgagtacacagttttgtctgaatcccaaaactgggcctgctacagtaaaacccaatgtcaagcaggtccccacagacccagacttcaagctggtactctcagactgaggcttcaggccctttctgacacagggctatatcccatggccccaggttcttagcctacccagtagactcagtctccaggacagcccaccaccaggccaacctcagcagccccaggctccagacttccctcagcaccagaccagccccagtggcctcaggtccctggctgccctacctccaggctgaaccaagtggccccaggttctggatcacctccagtacccagatgaccctcacagccacaggctttaggcctgccctagcactaggccaaccccacagcactagtcatcaggcaggtaccatggactgaacctgcaagcccttcccattgccaggcaggaacttgtagccacaggcttcaggccttcctggcagaagtggtttctggactgaactcagtgccaggccaactccagctattccatgctctagactagtcccagcaacaggtaggccctaggctttgggcccagccaagcaccaggggtttcaagcccactctagcacaggccagcacccatggacccagaaccttggctggctcttgcagatacaggatccaggtccgcacagcaccaagccagcccccgacttcaggcctaccatggcaacatgttggcaactctggcctcaaccaccaggcaggtacctgcagacacaggcttcaggtcagcctagtaccagactggctcctgtagccccaccctttagaccagcttatgtgggttcacattccagcagatccagtgtccaggccaggaccagaagatgcaaggtctaggtctgtcccagtagatcctagcactgtatgggtctccatggactcaggctctaggaatgcccttatgtatccaggtcctaggccagcctccaaggacccatgacctatgccagtctttacagaaaacttctaagccagcaccaacagacacaggctacaggccagtctctatggcctcaggctccaggtcagtccccatggctccaggcaacagacagtgcctacaatcccaggccccagagcagcccttgtggacctaggttccatctcagacccagcaccaggcaggtctcaggcttaaggccagactccatagcctctggctccagagcactcaggttccaggtatgccccacaagactcaggggccaggcccaccctggcagaccctggtaccaggccagatgccatgaactgaggctcaatgaccacccttacagacccaggcttcagaccagaccctgtggactcaaaatccagacctacctccttgaactcaagctccaggtctgctccagtgctatgcaagctcccaaggactcaggctccaggcctgtctcagagttcccaggtaccagggccactccagtgtcagcagatcccctgtggacccagacaccaggtcagcctacctgctgatccaggcaccaggccaacctgcccaaggactcctgcagcaagcataccctcactcgacacaagatggcctgcccataatctctggatgtgaagagctttcccagacaaagccagttctgcaaagactaaaataaatccctatttcttcaaatgtgcagacatcaaggtaaggcaataagaaataagaacaactaaaggacaaaacaccaccaaaagaacacagtaagcacccagtagctgaccctaaagaaatcaggatatgcaaactcccagatgaataattcaaaataattgtactaaggaagctcatctaacttcaagaaaatacagataaataaagcatttaagtcaggaaaacaatgaatgaacaaaatgagaaattctagagacagattgaaattattttaaaaatcaatcagaaattctagagctgaaaaatataatgaattaaattaaaactgatcaagcagaaaaaagaatctgaacttgaagacaagttatttgataacatatagtcagagaagaaaaaagaaaaaagaataaaaaggaatcaagaaagccaacagaatttatgaaatggaagaaaaagacaggagtagaaagcttagttaaagaaataatagcagaaaatttttcaaaattggaaaaggatataaatatccaggtacaagaatgtcaaaagtctccaatcagattcagttcaaacaagactacaccatgacatattataatcaagttgttaaaaatcaaggacaaagaaaggatcctgaaagcaccaaaagaagcaaatcacacataagtgagtttcaataaggctagcagtggatctctttatgaagaccttacaggccaagagacagtgagatgatacattcaatatattgaaggaaaaaaacggccaataaagaatattgtacccaagaaacctatcctccagaaatgaaggagagccatgacttccccagacaaacaaaagctaagggaattcatcaccaccagacctgtcttacaagaaatgctaaagggagtttttcaagctgaaagaaaaaaaaatgttaattcttaacacaaagaatctgaaggcataaaattcactggtaatagtaagcacacagtaaaattcaaaatacactaatactaaaagagttgtgtttaaatcacttatatctttagtatgaagattaaaagacaaaactactaaaaataatagtagcaaagatttgaataggcactgcactaaaaaagatacatgaatcgtaaataagcaagtacaaaaaatgttcaacatcattttccatgattgaaaggaaatttaaaactattaaataccactgcacatgtattaggatggctaaaacaaaaacctgacaaatatacataaacattgtactctagttgttaatttatcacaggggtacagattagcatttctgaaactacattaccacttatacccaggtctttcaatgtttcaaagaagttataaataagcaaaaacaaaaggtcggaataaaactctgtgatattagagtgagaggtatcaatatgaactgagggggtgtacatagatcagtacacatacatatattacttagctctttccactgagagaacagagaagcaggagtgccatggtaataatgtgcacactccatgccccgatcttgacttctaaataccattatccaataacatgaaccagaactaatgtttacaatggctgattccagaagacaaaagagaaatgatgaataattgcaatgtggtatcccagattggatacttgaatagtaaaagaacattagtagaaaaaaactagtgaaatctgaataaaatctgccatttagttaatagtaatgtgccaacgttaatgtttttagttttgacaaatgtgccatagttatataagatgttaatgttaatcagaaatagggtacaaaaaactctgtacttcaagttaaaaaaatcttaaaccattcaaaaaatgaaatatttatcttaaaaactcactaattctattgaattaaagacattttccctgtggctacaattattccttaagacatcacattcagatgtcacatgaactcattcaaagctgaccttgtctctcttgcccattgctgtactcccagcatctttactttgcttgtcacacaataggtatgcaataaatatttttaaaggagtcaaataaatgtttttcacatattcagttagaatatacactcagatgttacactcacttattcttttgtggcactcatttataacccatttcctaattcagatgtcaaacacacactcaggtattttacatatatttttttcagatgtagcacacagtcctccacatatcatacatagtatcttagctgtcataggtatacaactgttacttacactcttttggacattactcacatattataacacataccctaattcaggtgtttaatacaaagtttagatgaatagcttgcttacatggatgccacaaacacccattcaatgtttaattgaatgttttaattgggatattaaaaaattcagatattacacatgcagatgtcaactttgacaatcacacattcatcatgatatcaaatatactcaacaaaatgcaatacacactctcttagatgccaaacactcattgagaagttataatgttttttgtcattacagtcattcagttgtgaacccctcattgagtagtcttatacgttcatgcagaggacacaattagttttaatctacacattcaaatattatccacacatttaaaaggtcacattcagataatacatatgcaaactatttgacatgttgctcacacaatgaaatggaatatacccattctaaggttaaacccttcattggatgtcataaccacttctcagatcaaaatacacttaataggatgcaaaccacatattcagctagtccacattctaaggtataatccatgttcagtctatatgtcacacacatttaattggatgttatcttagtccatttgtgttactataaaggaatacctgaggctgggtaattgataaaacagatttacttggctcacagttcctcaggctgtacaagaagcatggcaccaacatctgcttctactgaaggtagaaggtgaaggggagcaggcatcacatggcaaaagaggaaggaagagagaggggagagaggtgccaagctcttttcaacaatcagctcttgcgaaaaataagagtgagaactcattactgcaagaatgacacaaagtttttcatgagggatccaccactatgatccaaacaccccgcattaggccacaactccaacattgagaattacatttctgcctgagattttgaggggacaaatatctaaactatatcagatataaaatgcttacaatgagatattcaaaacatttatttatctcacacttctttgtgtgatgtgcacatttatcctgatgttaccctcacaatcaggttaggtattttacttacatgtccttgaatcattgctggtttcccaataattacataattttggactctcagttttcttgtccatgaccttttccatgtgggcaggttttgatctctcttaggtagaatgggaaatgtataaaaagagcagatgggagaaaaggatggtctatcacaactctctctctcttacgtgcccacagacacacacacacacacacacacacacacacacacacacacacacacacacacacacctgaccaggtcctaggtaacctaaataatatgcaactcttcattggtttcccctaaaggggcaggaccagtcttcccaaggactttaacaacctgtttgagtttttatgcttttccccctccccagctgtattaagttataattgataaataaaacttgtatatatttaagctatacaacatgataatttgatatatgtacacattgtgaaatgattaacacaatcagattaatcaacacaaccatcacctcacatagttaccagtttttttaaaaaaattagtttcagtggtacatgtgcaagtttgttaaacagatatattatgtaatgctggggtttggacttctgttgaacccgtcccccaaatagtgaacatagtacttaatagttagttttacaacccttgtcccttccctccctccccacttttggagactccagtgtctattgtttccatctttatgtctgtgtaccactttttaaatttttattttttagagagggtcttgctatgttgcccaggctgttcacagactctgaacttaagtaacccccacaacctcagcctcctaagtagccaggactacaggtgtatgcctctgtgcacagctgttaccactttttgcgtgtagtgcgagcatttaggatctactctcttattagatttcaatgatacaatacagtattattaattatagttaccatgctgtatattattaatagatttccaggacttattcaccttataacagaaatattgtgccctttgctaacatctcccaatttcctctaccccccagtacctggcaaccaccattctactcttagcttccatgagttcaacttctttagattccacatataaggggatatcatatatatttgcttttttgtctctgacttacttcacttaacataatgtcctccaggttgattcatgttattacaattggcagaatttccttctttttttggtggaataatattccaatgtgtgtgtgcacgtgtgtgtgtgtgtgtgtgtgtgtgtgtattacctccattgtctttattcattcaactgtcaatggacatttaggttgtttctacatcttggctgttgagaataatgctgcaataaatgtgggaatgcagatatctttatgacatactgattctatttcattcggatatatactcagagtgtaactgccggatcttacggtagttttatgttttttttaatggtaattctatttttaattttctgagggatcgctatgctattttccatagcagctgcacgattttgcattccttttttttttattatactttaagttttaggatacatgtgcacaacgtgcaggtttgttacatatgtatgtatacatgtgtcatgttggtgtgctgcacccattaactcgtcatttagcattaggtatatctcctaatgctatccctgtcccctccccccacccacaacagtccctggtgtgtgatgttccccttcctgtgtccatgtgttctcattattcaattcccacctatgagtgagaacatgcagtgtttgttattttgtccttgcgatagtttgctgagaatgatggtttccagcttcatccatgttcctacaaaggacatgaactcatcattttttatggctgcatagtattccatagtgtatatgtgccacattttcttaatccagtctatcattgttggacatttgggttgttccaagtctttgctattgtgaatagcaccacaataaacatacatgtgcatgtgtctgtatagcagcatgatttataatcctttgggtatatacccagtaatgggatggctgggtcaaatggtatttctagttctagatccctgaggaatagccacactgacttccacaatggttgaaccagtttaccgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttctcatgtgttttttggctgcataaatgtcttcttttaagaagtgtgtgttcatatccttcacccactttttgatggggttgtctgtttttttcttgtaaatttgcttgagttcattgtagattctggatattagccctttgtcagatgagtaggttgcaaaaattttctcccattttgtaggttgcctgttcactccgatagtagtttcttttgctgtgcagaagctctttagtttaattagatcccatttgtcaattttggcttttcttgccattgcttttggtgttttagacatgaagtctttgcccatgcctatgtcctgaatggtattgcctaggatttcttccagagtttttatgattttaggtctaacatgtaagtctttaatccaacttgaattgatttttgtataaggtgtaaggaagggatccagtttcagctttctacatatggctagccagttctcccagcaccatttattaaatagggaatcctttccccattgcttgtttttgttaggtttgtcaaagatcagagagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgtcttggcaatgcgggctcttttttggttccatgtgaactttaaagtagttttttccaattctgtgaagaaagtcattggtagcttcataaggatggcattgaatctataaattaccttgggcagtatggccattttcatgatattgattcttcctatgaattagcatggaatgttcttccatttgtttgtgtcctcttttattttgttgagcagtggtctgtagttctccttgacgaggtccttcacatcccttataagttggattcctaggtattttattctctttgaagcaattgtgaatgggagttcactcatgatttggctctctgtttgtctgttattgatgtataagattgcttgtgatttttgcacattgattttgtatcctgacactttactgaagttgcttatcagcttaaggagattttgggctgagacgatggggttttctagatatacaattatgtcatctgcaaacagggacaatttgacttcctcttttcctcattgaatgccttttatttctttctcctgcttgattgccctggccagaacttccaacactatgttgaataggaatggtgagagagggcatccctgtcttgtgccagttttcaaagggaatgcttccagtttttgcccattcagtaagatattggctgtgggcttgtcatagatagctcttattattttgagataagtcccatcaatacctaatttattgagagtttttagcatgaaacgttgttgagttttgtcaaaggccttttctgcatctattgagataatcatgtggtttttatctttggttttgtttacatgctggattatgcttattgattttcatatgttgaaccagccttgcatcccagggatgaagcccacttgatcatggtggataagctttttgatgtgctgctggattcggtttgccagtattttactgaggatttttgcatcaatgttgatcaaggatattggtctaaaattctcattttttgttgtgtctctgccaggctttggtatcaggatgatgctggcctcataaaatgagttagggaggattccctctttttctattgattggaatagtttcagaaggaaaggtactaggtcctccttgtacctctggtagaattcggctgtgagtccgtctggtcctgaactttttttggttggtaagctattaattattgcctcaatttcagctcctgttattggtctattcagagattcaacttcttcctcgtttagtcttgggagaatgtatgtgtcgaggaatttctccatttcttctagattttccagtttatttgtgtagaggtgtttatagtattctctgatggtagttgcatttctgtgggattggtggtgatatcccctttgtcattttttattgtgcctatttgattcttgtctcttttcttctttatcagtcttgatagcggtctaacaattttgttgatcttttcaaaaaaccagctcctggattcattgattttttgaagggttttttgtgtctctatttccttcgtttctgctctgatcttagttatttcttgccttctcctagcttttgaatgtgtttgctcttgcttttctagttctaccctgtagtcattcaggagcaggatgttcagtttccatgtagttgagtggttttgagtgagcttcgagtttcattgccctgtggtctgagagacagtttgttataatttctgttcttttacatttgctgaggagtgctttacttccaactgtgtggtcagttttggaataggtgtggtgtggtgctgaaaaaaatgtatattctgttgatttggggtggagatttctgtacatgtctattaggtctgcttggtgcagagctgagttcaattcctggatatccttgttaactttctgtctcggtgatctgtctaatgttgacagtggggtgttaaagtctcccattattattgtgtgggaacctaagtcactttgtaggtcactaaggacttgctttatgaatctgggtgctcctgtattgggtgcatatatatttaggatggttagttcttcttgttgaactgatccctttcccattatgtaatggccttctttgtctcttttgatctttgttggttgaaagtctgttttatgagagacttggattgcaacccctgcctttttttgttttccatttgcttggtagatcttcctgcatccctttattttgagcctatgtgtgtctctgcacgtgagatgggtttcctgaatacagcacactgatgggtcttgactctatccaatttgccagcctgtgccttttaattggagcatttagcccatttacatttaaggttagtattgttatgtgtgaatttgatgctgtcattacgatgttagctggctattttgctcgttagttgatgcagtttcttcctagccttgatggtctttacaatttggcatgtttttgcagtagctggtaccagttgttcctttccatgtttagtgcttccttcaggagctcttttagggcgggcctggtggtgacaaaatctctcagcatttgtttctctgtaaagggttttctttctccttcacttatgaagcttagtttggctggatatgaaattctggattgaaaattctttgctttaagaatcttgaatattggcccccactctattctggcttgtagagtttctgctgagagatcagctgttagtctgatggtcttccctttgtgggtaacctgacctttctctctggctgcccttaacattttttccttcatttcaactttagtgaatctgacaattatgtgtcttggagttgctcttcttggggagtatctttgtggcattctctgtatttcctgaatttgaatgttggcctgcgttgctagattggggaagttctcctggataatatcctgcagagtgtttccaacttggttccattctccccgtcactttcaggtacactaattagatgtacatttggtcttttcacatagtcccatatttctttgaggctttgttcatttctttgtattctttttgctctaaactacccttcatgcttcatttcattcatttcatcttccattgctgataccctttcttccagttgatcgcatcgcttactgaggcttgtgcatttgtcacatagttctcgtgccgtggttttcagctccatcaggtcctttaaggacttctctgcattggttattctagttatccattcgtctaatttttttttcaaagtttttaacttcttcgccattggttcgaacttcctcctttaactcagagtagtttgatcttctgaagccttcctctctcaactcgtcaaagtcattctccgtccagctttgttccattgctggtggggagctgagttcctttggaggaggagaggtattctgaattttagagtttccggtttttctgctctgttttttccccatctttgtggttttatctacctttggtctttggtgatggtgacgtacagatgggtttttggggtggatgtcctttctgtttgttagttttccttctagcagacagaaccctcagctgcaggtctgttggagtttactggaggtccactccagaccctgtttgcctgggtatcagcagcagtggctgcagaacagcggatattggtgaaccacaaatgctgctgcctgattgttcctctgaaagttttgtctcagaggagtacccggccgtgtgaggtgtcagtccactcctactggggggtgcctcccagttactctactcgggggtcagggacccacttgaggaggcagtctgcccgttctcagatctcaagctgcatgctgggagaaccactactctcttcaaaactgtcagacagggacatttaagactgcagaggttattgctgtcttttgtttgtctgtgccctgcccccagaggtagagcctacagaggcaggcaggcctccttgagctgtggtgggctccacccagtttgagcttcctggctgctttgtttacctactcaagcctgggcaatggcggacgcccatcccccggcctcgctgccaccttgcagtttgatctcagactgctgttctagcaatgagcgagcctccgtgggtgtaggaccctctgagccaggtgcaggatataatctcctggtgttccatttgataagcccgttggaaaagcgcagtgttagggtgggagtgacccgattttccaggtgccgtctgtcacccctttctttgactaggaaagggaattccctgaccccttgcactttctgggttaggcaatgccttgccctgctttggctcatgcatggtgcactgcacctactgtcctgcacccactgtccagcactccccagtgggatgaacccggtacctcagttggaaatgcagaaatcacccgtcttctgtgtcactcatgctgggaggtgtagactggaggtgttcctatttggccatcttggctccacccatgaactcatcattttttatttctgcatagtattccacggtgtatatgtgccacattttcttaatccagtctatcattgttggacatttggcttggttccaagtctttgctattgtgaattgtgccgcaataaacatgcgtgtgcatgtgtctttatagcagcatgatttctaatcctttgggtatatacccagtaatgggatggctgtgtcaaatggtatttctagttctagatgcctgaggaatcgccacaccaacttccacaatggtggaaccagtttaccgtcccaccaacagtgtaaaagtgttcctatttctccacatcctctccagcacctgttatttcctgactttttaatgatcgcctttctaactggtgtgagatggtatctcattgtggttttgatttgcatttctctgatggtcagtgatgatgagcattttctcatgtgttttttggctgcataaatgtcttcttttgagaagtgtgtgttcatatccttcacccactttttgatggggttgtttgtttttttcttgtaaatttgtttgagttcattgtagattcttgatattaaccctttgtcagatgagtaggttgcaaaaattttctccaagcaatggcaacaaaagccacaattgtcaaatgggatctaattaaactaaagagcttctgcacagcaaaagaaaccaccatcagagtgaacagccaccctacagaatgactttttttttttttaaagaaaaagccaaacctctttctaaaatgatccacccatcatttgcaggcattaaattcttcagctttaaatcattcactttttttttttttgctttaaggtgtcatacaatcacttcactttttctcaaatctctttcttagagctgtccttcacccacatatgagctgaattttcagtacaagataaaaaggtattttgccaaaaatgcaagattttagtgcctgctggcatacctgcagtgacaacttcacaaatttccttttctttttttacactgttccttatgctggattaatttatcttgaaatggcagacaaccacagcttcagactcaatctatggttcatatcaggcaattcaactttttcttggaatgtcatgactcttctctacatcttgggagcacttccagaatcactagtagcacttcgtgtacatttcatggtgttattcaaggtttaggatattgcactaaacatgatgaaaaacatacaggaaacatgagagattactttttctgtgatgcatactttaccagaggaagaaattgctcaagtgaagatcattaccatcacatggagttttaagctgatattttaaaaacttgagctcaccacaatagcatcataaggtggataagaagttattgcagtagtacttcttatagtactacttcttatagtagtagaaaagtagtgctacagtatgtagctacagttaattttatgcagtcatgattcaatactgcatctttacatttttttacatttcttttgactgcgagtggtacaatgtatggtctgtttttgtgtgtgcatgttttgataacttttaattttttataatatgtttatatatattttattatagtaaatgataaaatagactagttatctatatacattttatgcatttgttacatacttaactttttttccccatatttccaggctatgcagttgacctttgagttttctcaaattgtcacaaatctccagaaaattttccaatatatttatttttaaaaatccacatagaagtggacttaaaaagttcaaacccatgtttttcaaaggtcaattttattataaaataacattctatgtaaagaaagatgatgatgatgatttagatatgggagaatacttaagataaactaaggtggccaattccaactgagaaatggcagaagccagtgagtcagccatgagatgtgtttgcagtttggactgtctaaatgtcaagttcaaagttcagagagctaaaatgaggcccaaatgaggaaaatctgtttttttttttttgagatcagtttaagaagcagaacactgtctttctgctactgaggctggtgcatgaacccctgagggaaaagacaggtgtaggggaaccactgggtttcaggaggccttgacctcttcccaccaacagacatttaccttatcttttcacggatggaatctaccagccatgcctgaaaacaccaagtactgacctctggatgggaacctggcaaagactgagggcatacttatcttaatgggtacaatgtaacgtttcaatgtcactgagatacatctgaatatgtggggtcactggtgaaaatccaacagaatggggctagtatttgtttggagtagacaagaatgctttactttatgtcttacactgctgctttgctctgtcacaaggctttctataatggagacatacacacagatacctacaatatcccttactggaccagtttctataacccctcaatgaagagccttctggtggagttgaataaaagaacaaatttaagctcaagaaagaagcaggatcttttccactctctaactgcaacttatcaccagctgacccctagtgtgcagacaacagagccccaaatctccagtaagaagaaaggaatagggagtaatgtggcagagcccagccttcatagcaggcactggctcaggttatcactttggtattgtgagagggaagagcatggccatgtcctacatgcatgggtgtcacgttggacggtggtactgctgatagtgctcctgaatctgacatatcacgtcagtcttcctttgtccaagggaggagtgacaaaagggcttgggagaaaagcgttttctgtaagattaggaatactgaaaagagaatcctgcccccacctccaatgacctggaactatggatagaagctggtctgaacacagagaaaagtagactgtgtgtaaaaattcattttactgctaaaatcccaaatccaccagttctggaatctgttaaaatgagggtccatagacaaaaacggatgtaaatttttaaaagtgatttttcttgtttacagatctattgaagtataattgacaaataaaagtgtatatctttaagttatatcttgatgttttggtatacattgtgaaataatcaccacaatcaaattaattaatatatccatcaactcatataattttgggttttaccgctttttgtgttgagcaatttagatctgtctccttagcaaatttcaagtatataatgcagtgttgttaactatagccacattgctgtacattagatcttcagaatgtattcatcttgcataactgaaactttgtatcctttgatcatcatctcatttctccctcccccagccactggcaaccacccttttagtgtctgattctatgagtttgactattttacttacctcataagagtggaaacatgcagtatttgtccttttgtggctggcttatttcacgtaacataatgtcctcatgatggctgttgtcaagacaggaaaagacaacaagtgttggcgaggacgtggagaaattagaacacttgcatgctgttggtgggaatgcaacagtgaagctgctatggaaaacagcatggagattccttcaagaaactacaaatagaacagccatatgattcagcaattccacttttgggtatttatccaaaagaattgaaatcaggatgtcaaggaggtatctgcactccaatgtttatagtggcattattcacaatagccaagaagtggaaacaacctaaattccctcagtagatgagtggatttatgaaacaaacaaacaaaaaaacttgctaacagtttgtgaatatagcttcattgccttttggcttaaaacgctggtgtgaaaatctgagctcaaactatgtttcctccttgtatgtaatttgctttctctgcctggatatctgaataactacgtttttatctttgaacttaaataacttaaattggattcatctttgtcattatttctttacacatttttctgatatgtggtgtgatttttttgatccgcagctttattacatcttctatttcaaggaaaattttctatattatactgtttatattatattccattgtagcatcctctactttaaggaatccaactaaactaattttatattaactttttttctccatttttatgatttccctaatttctataattttgtgttcttgttcaaacacactgtaatgatcacaagacattttttcctgaagttattctttttaaaaataaaccttttattttagaatagtgttagatttacaaaaaaagtgaagatagtacaaatagcagagagactttcttctgttattaacatcttacattagtattgcagatttgtcacaattaataagtcaatacactataaagacacatgcacacgtatgtttattgtggtattattcacaacagcaaagacttcgaaccaacccaaatgtccaacaatgatagactggattaagaaaatgtggcacatatacaccatggaatactatgcagccataaaaaatgatgagttcatgtcctttgtagggacatggatgaaattggaaattatcattctcagtaaactatcgcaagaacaaaaaaccaaacaccgcatattctcactcataggtgggaattgaacaatgagaacacatggacacaggaaggggaacatcacactctgaggactgttgtggggtggggggaggggggagggatagcatcgggagatatacctaatgctagatgacgagttagtgggtgcagcgcaccagcatggcacatgtatacatatgtaactaacttgcacattgtgcacatgtaccctaaaacttaaagtataataataataaataaaaaaataagtcaatattagcatgtattaactaaagcctatacttagatttctgtgtttttacctaataactcttttctattctaggattccatccaggatatcacattacatttagtcatcatgtttccttaggtcctcctgctctaaaagtttctcagatttcccttgtttttgattaccttgatggtttttaggtgtactggtcaggaattttatagaatgtctcttacttgggatttgtctggtgtttttataatgattggagtgggattacaggatttgcggaagaagcctacagaggtaaaatgccattctcatcacattatatcaagtgtacataatatcaacatgatttttcactgctgagttttactttgatcacttggctgatggtgtttgtcaggcttgaacacggaaaagctactaattttttcacctttgcatactttactctttgaaataaagtcactatgagaaacccacattttctatctttttatttattttcattgtattttatgttattgaggtattcatgtgtcatggtggtttgctgcatctatcaacccatcatctaggttttaagccccgcatgcattagctatttgtcctaatgctctccattccctcgccccccacttcactactggccctggtgtgtgttgttcctctccctgtgtccattctattctcctccgtatattttcttcaataatgtatttatattaatatggaattgtggataattatttcatactctggattataatctaaacctactttattttgttgctcaacctatttcagctttgatcattggaactttttcagcggactcctgtgtccttttgacttactcttgtcatttattgtatttttgagcactttcttactttctggcattataggatacccctctaatcttttttctacctttattgtgggtataattgacaaataaaattgtataaatttaaggtatacaatgtgatgatttgatatatgtacacattgtaaaaatcacaatcaagttatttaacacatctttcaccacacctagttatcattttggtgcattgtggtgagaaatttaccatctactgttttagcaaatctcagatatacaatacattatttttaactatagttaccatgcgtacatcaaatcttattcatctcatcactgaaagttggtactctttgaccaacatttccccatttcccacacttctcagcccctcataaccatcattctactactgtctgtttctacgaatctggcatttttaggttccacatataggtggagtgcagtataagtgagatcactcagaatttatctttctgtagttgacttatttcatttagcataatgccttcaagattcatccgtgttgtcacaaatggcaagagttccttctttgctatggttgaatactattccattcatatatatatacacacagtataggtatatatgcataatacatatatacataatttttgtccgttcatctgttgacagacacttagattgcttccatgtctattggatattgtgaatattgctgcaatgaataatggctgttgtgaataatgctgcaatgaacatgggagtgcagagatctctaagacatactgatatcatctccttcagatatatacccaaggaatcatatggtagtatatttttaattttttgaggaaactccctactattttctataatggttgcatcaatttacaatcccaccagcagtgtacagggttttcttttctccatattcttgctaacgcttgttatctcttgtccttttgattatacctatcctaacaggtttaagaaaaaaagcatttgtcgaaatccaacatcctttcatgataaaaactctcaacaaattgagtatagaaagattgtgcctcaacatcataaaggccatatatgaaaaccccacagctaacatactcaacagtgaaaaactaaaaatttttcatctaagatgaagaataagataagggtgcctactctcaccatttctatttaacatactactagaagtcctagctagggctattaggcaagaaaaagaaacaaaagtatacatattagaaagggaaaagtaaaattgaccatgtttgcagatgacacgctcttacatatagaaaaccctaaaaaaaacaaaacccattagaattcataaattaattcagtaaagttatacaaagtaaacccacaaaaagtcagttgcatttatatacactaacagtgaactacctgaaaaagaaatgaagaaaacaatctcatttactaaactcgaaacaataaaatacttaggaacaaatttaaccaaggaagtgaaagatctgtaccctgaaaactataaggaaaaagttctgatgaaagaaattgaaaggacacaaataaattgaaagatatctcgtggtgtgcaagaattaatattgttataatgtccatactacccaaagtggacctatagattcaatgcaatccataccaaattccaggcatcacatttcctgatttcaaattatattacaaggatatatactcaaaacagtattatactggcttaaaaacagacatatagaccaagggaacaaaacagagagccctgaaataaactcaagcacataaggtcaacttacctttggcaggtgtgccaagaatacacaatggggatgggagagtctcttcaataaatgatgttggggaaactggacattcatatgcaaaacactgaaattgaactcctatcttacagcatacacaaaaacaaactcaaaatagtttaaaggcttaaatgtaagacttaaaaccagaaacctcctaggagaaaatataagggaaaaagtccttgacattgctcttggcaattattttttggctatgacaccaaaagcgaaaagcaaataaaacaaaaataaacaagtgagacttcggcaaactgagaagcttctgcacagtaaagaaacaaacaatagaattaacaggcagactatagaatgggagaagataattacaagccatgtaactgataagaaattatcatccaaaatatataaggaactcatacaattcaatagcaaagaaacaaataacccaatttaacaatggggaaaggacctaaatagacattttccaaaaaaaatcataaaaatgtccaggccaggcacagtggctcacacttgtaatcccagaactttgggaggccaaggcgggcagatcatgagttcaggagatcgagacgaccctggctaacatggtgaaaccccgtctctaataaaaatgcaaaaaaattagtcaggcgtggtggcaggcgcctgtagtaccagctactcgggaggatgaggcaggagaatggtgtgaacccagaaagcagagcttatagtgaggcgagatggtgccactgcactccggcctgggtgacagagtgagactccatttgaaaaaaaaaaaaaagtccaaaaggtatattaaaatgtgttcaacatcactaatcataaggaaaatgcaaatgaaaaccacaatgagatatcacctcacacctgttaggatggctattatcaagagaacaagaggtaacaagtgttggtgagagtgtaaagaaaagagaacccttgtatactgttggtaaggatgtaaactggtaaagcaattatggaaaacagtatggaggttcttaaaaaataaacatggagggtggagccaagatggccgaataggaacagctccagtctacaccacccagtgtgaacaacacagaagatgggtgatttctgcatttccaactgaggtaccgggttcatctcactggggagtgccagacagtgggtgcaggacagtgggtgcagctcactgtgcatgagcaaagcagggtgaggcattgcctcacccaggaagcacaaagggtcagggaattccccttcctagtcaaagaaaggggtgacagacggcacctggaaaatcggatcactcccaccctaacactgcacttttccaatgggcttatcaaatggaacaccaggagattatatcctgcacatggctcggagggtcctacacccacggagcctcgctcattgctagaacagcagtctgagatcaaactgcaaggtggcagcgaggctgggggaggggcacccgccattgcccaggcttgagtaggtaaacaaagcagccaggaagctcaaactgggtggagcccaccacagctcaaggaggcctgcctgcctctgtaggctccacctctgggggcagggcacagacaaacaaaagacagcaataacctctacagtcttaaacgtccctgtctgacagttttgaagagagtagtggttctcccagcatgcagcttgagatctgagaacgggcagactgcctcctcaagtgggtccctgacccccgagtagcataactgggaggcacccccaagtaggagtggactgacacctcacacggctgggtactcctctgagacaaaactttcagagggacaatcaggcagcagcatttgtggttcaccaatatccgctgttctgcagccactgctgctgatacccaggcaaacagggtctggagtggacctccagtaaactccaacagacctgcaggtgagggtcctgactgttagaaggaaaactaacaaacagaaaggacatccaccccaaaaacccatctgtacatcaccaacatccaagaccaaaggtagataaaaccacaaagatggggaaaaaacagagcagaaaaactggaaactctaaaaatcagagcacctctcctcctccaaaggaactcagctccccaccagcaatggaacaaagctggacggagaatgactttgacgagttgagagaggaaggcttcagaagatcaaactactccgagctaaaggaggaagctcaaccaatggcaaagaagttaaaaactttgaaaaaaaattagacgaatggataactagaataaccaatgcagagaagttcttaaaggacctgatagagctgaaaaccatggaacgagaactacgtgatgaatgcacaagccttagtaactgatacgatcaactggaagaaagggtatcaacgatggaagacaaaatgaatgaaatgaagcatgaaaggaagtttagagaaaaaagaatacaacgaaatgaacaaagcctcaaagaaatatgggactatgtgaaaagacaaaatctacgtctaattagtgtacctgaaagtgatggggagaatggaaccaagttggaaaacactctgcaggatattgtccaggagaacttccccaatctagcaatgcaggccaacatttaaattcaggaaatacagagaacgccacaaagatactcctcgaaaagagcaactccaagaaccataattgtcagattcaccaaagttgaaatgaaggaaaaaatgttaagggcagccagagagaaaggtcaggttacccacaaagggaagcccatcagactaacacctgatctcttgggagaaactctgcaagccagaagagagtggggaccaatattcaacattcttaaagcaaagaattttcaacccagaatttcatatccagccaaactaagcttcataagtgaaggagaaataaaatcctttacagacaagcaaatgccgagagattttgtcaccaccaggcctgccctaaaagagctcctgaaggaagcactaaacatagaaaggaacagctggtaccagccactgcaaaaacatgccaaattgtaaagaccatcaaggctaggaagaaactgcatcaactaacgagcaaaataaccagctaacatcataatgacaggatcaaattcacacataacaatgctaacctcaaatgtaaatgggctaaatgctccaattaaaaggcacagactggcaaattggatagagtcaagacccatcagtgtgctgtattcaggaaacccatctcacgtgcagagacacacatagactcaaaataaagggatgcaggaagatctaccaagcaaatggaaaacaaaaaaaggcaggggttgcaatcctagtcactgataaaacagactttaaaccaacaaagatcaaaagagaaaaagaaggccattaaatagtggtaaagggatcaattcaacaagaagaactaactatcctaaatatatatgcacccaatacaggagcacccagattcataaagcaagtccttagtgacctataaagtgacttagattcccatacaataataatgggagaggttaacacaccaccgtcaacattagacagatcaacgagacagaaacttgacaaggatatccaggaattgaactcagctctgcaccaagtggacctaatagacatgtacagaactctccaccccaaatcaacagaatatacatttttttcagcaccacaccacacctattccaaaactgaccacacagttggaagtaaagcactcctcagcaaatgtaaaagaaaagaaattataacaaactgtctctcagaccacagtgaaattaaactagaactcaggattaagaaactcactcaaaaccactcagctacatggaaactgagcaacctgctcctggatgactactgggtacatacgaaatgagggcagaaatgaagatgttctttgaaaccaatgagaacaaagacacaacataccagaatctctgggacacattcaaagcagtgtgtagagggaaacttatagcagtaaatgcccacaagagaaagcaggaaagatccaagattgacactcttacatcacaattaaaagaactagagaagcaagtgcaaacaccttcaaaagctagtagaaggcaagaaataactaagataagagcagagctgaaggaaatagagacacaaaaaacccttcaaaaaatcgatgaatccagggctggttttttgaaaagatcaacaaaattgatagaccgctagcaagactaataaagaagaaaagagagtagaatcaaatagatgcaataaaaaatgataaaggggatatcaccaccgatcccacagaaatacaaactaccatcagagaatactataaacacctctacgcaaataaactggaaaatctagaagaaatggagaaattcctcaacacatacaccctcctaagactaaaccaggaagaagttgaatctctgaatagaccaataacaggctctgaaattgaggcaataattaatagcttaaaaaccaagaaaagttcaggaccagacggactcacagccgaattctaccagaggtacaatgaggaactggtaccattccttctgaaactattccaatcaatagaaaaagagggaatcctccctaactcattttatgaggccagcatcatcctgataccaaagcctggcagagacacaacaaaaaatgagaattttagaccaatatccttgatgaacattgatgcaaaaatcctcaataaaatactggcaaaccgaatccagcaacacatcaaaaagcatatgcaccacgatcaagcgggcttcatccctgggatgcaaggctggttcaacatatgaaaatcagaaagcgtaatccagcacacaaacagaaccaaagataaaaaccacatgattatctcaatagatgcagaaaaggcttttgacaaaattcaacaaggcctcatgctaaaaactctcaataaattaggtattgataggacgtatctcaaaataattagagctatctatgacaaacccatagccaatatcatactgaatgggcaaaaactggaagcattccctttgaaaactggcacaagacagggatgccctctctcaccactcctattcaacatagtgttggaagttctggccagggcaatcagacaggagaaggaaataaaaggcattcaattaggaaaagaggaagtcaaattgtccctctttgcagatgacatgattttatatctagaaaaccccatcgtctcagcccaaaatctccttaagctgataagcaacatcagcaaattctcaggatacaaaatcaatgcacaaaagtcacaagcattcttatacaccaatagcagacaaacagagagccaaatcatgagtgaactcccattcacaattgcttcaaagagaataaaatacctaggagtccaacttacaagtgatgtgaaggacctcttcaaatagaactacaaaccacggctcagtgaaataaaagaggatacaaacaaatggaagaacattccatgctcatgggtaggaagaatcaatatcgtgaaaatggccatactgcccaaggtaattatagattcaatgccatccccatcaagctaccaatgactttcttcacagaattggaaaaaactactttaaagttcatatggaactaaagaagagcccacattgccaagtcaatcctaagccaaaagaacaaagctgggggcatcacactacctgacttcaaactatactacaaggatacagtaaccaaaacagcatggtactcttaccaaaacagagatatagaccaatggaacagaacagagccctcagaaataatgccacatatccacaactgtctggtctttgacaaacctgacaaaaacaagcaatgaggaaaggactccctatttaataaatggtgctgggaaaactggctagccatatgtagaaagctgaaactggatcccttccttacaccttgtacaaaaattaattcaagatggatgaaagacttacatgttagacctaaaaccataaaaaccctagaagaaaacttaggcaataccattcaggacatagggatgggcaaggacttcatgtctaaaacaccaaaagcaatggcaacagaagccaaaattgacaaatgggatctaattaaactgaagagattctgcacgcaaaagaaaccaccatcagagtgaataggccacctgcagaatgggagaaaatttttgcaacctactcatctgacaaagggctaatatccagtatctacgatggactcaaacaaatttacaagaaaaaaacaaacaaccccatcaaaattgggtgaaggatatgaacagacacttctcaaaagaagacatttatgcagccaaaacacacatgaaaatatgctcatcatcactggccatcagagaaatgcaaatcaaaaccacaatgagataccatctcacaccagttagaatggcaatcattaaaaagtcaggaaacaacaggtgctggagaggatgtgaagaaacaggaacacttttacacagttggtgggactataaactagttccaccattgtggcagttggtgtggcgattcctcagggatctagaactagaaataccatttgacccagccatcccattactgggtatatacccaaaggactataaatcatgctgctataaagacacatgcacatgtatgtttattgtggcactattcacaatagcaaagacttagaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacactgcatgttctcactcataggtgggaattgtacaatgagaacatatggacacaggaaggagaatatcacacagtggggactgttgtggggtgggggaaggggggagggatagcattaggagatatacctaatgctaaatgatgagttaatgggtgcagcacaccaacatggcacatgtatacatatgtaacaaatctgcacgttgtgcacatgtatcccaaaacttaaagtataataataaaaaaagaattatgagttcttgtcctttgtagggacatggatgaagctggaaaccatcattttcagcaaactattgcaaggacagaaaaccaaacaccacatcttctcactcatatgtgggaattgaacaatgagaacatgtggacacaggaaggggaacatcacacaccggggactgttgtggggtggggggatgggggagggatagcattaggtgatataactaatgctaaatgatgagttaatgagtgcagcacactaacatggcacgtgtatacatatgtaagaaacctgcacgttatgcacatgtatcctaaaacttaaagtataataataataataataataaataaaaataaataaataaaaagtcaaaataactggagaaatagcttctgccaaccaagaagcaagtgagttcctcgacactattaagaaaatcattgaggggaggccgggcacagaggctcactcctgtaatcacagcactttgggaggccaaggcaggcaggtcacctgaagtcaggagtttgagaccagcctgagcaacatgatgaaactccatctgtattaaaaatacaaaaaattagccaggcttggtggtgtgtgcctgtaatcccagtgacttgagaggatgaggcaggagaatcgcttgagcctgggatttggaggttgcagtgagccgagatcacaccactgcactccagcctggatgacagaatgatattctgtctcaagaaaaaaaaaagaaaagaaaagaaaaaaagaaaaaagaaaaagaaaatcattgaggggaaagggtatttgtcataacaggttttaatgcagattgaagtgccctattctggaaaaaatgtcacaaaggacatttattaataaggaagagaaatgaacaccaggacttaaggcttgaagggataggctatctctactgttttgtgtaaaagcagtcagccttataattggaactgctgctcacccctgtgcctggaagggaaaaaataaataacagttggcagtcttttgattgtacaacaggaaggcctggacaatgagagcttttactgaattggttacatttacaccttgtccctcaaggcaggaagtactttgctactaagggaccaccttttaaagttcttttaattttgaacaatgtccctggagacccagaatcctataagtacaacaccaaatgcatggaagtagtctacttgtcccccaacacaatgtctctaattcagcctctagatcagggggtcataaggacctttaagtctcattatatatggtactctaagaaaaagattatcaacactatggaagagaaccctgatggaaagaacataatggaagtctacaaggattacatcattgaagatgccatcgttgttacagaaaaagctatgaaagccatcaagccccaaacaataaattcctgctggggaaaactgtccagattttgtgtacgagttaacaggatttatggtggaggcaatcaaggacatcatgaaagagattgtgaatattgaaaaaacaaggtagggggtgaaggatttcaagatacggatcttggagaaattcaagagctaacagacaccacaccagaggaattgacagaatgcaacttgatggagacaagtgctttcaatgtcagacgatgagaaagaagacagaagaagcaatgccagaaaaccaattgacattagataatatgacagtagagttccagttatttaagactgcttttgatttcttttaggacactgaccttctatgatacaggcactgaaatgaaagcaaacagtgggagaaggattggtacagtatagaaacatttttagaaaaatgaaaaacagaaaagtcagacagaaattacaatgtgtttctgtacagttacaccaaatgtgcctacctctcctgcctccccttccatctgctccaccttttccacctctactactcccgatgcagaaagaccaacccctctttctcctcctccttctcagtctagtcattgtaaagatgacaaggatgaagacctttatgatgatcaatactcaaacattcacttaatgaatagtaaatttattcctcttctttatgattttcttacattttcttttctctagcttactttattgtaagatagagtatataataggtataacatataaaatatgtgttaattaactacttacgctatcagtaaggcttctggttaatagtaggctattagaagttaattttggcagggaatcaaaagttatacacagatttttcaacttcacggtggaggggggtcagtgctcctaatcctgtgttatgcaagggtcagctacccctcacattttaccttcagatagacaacacatatcactactgtctttttgcttttcagctattactaagttgtatattgaaaatatttttgcacattcttgtgtacctagacaaaaactgccctatctaccccaaacaaaaggatctgtggaaagaaattatttatctgatgacaaatttttcctctatgacaactatctgaataagcctcacaagtatgctagttgatcagtgtctcacggtggcctgtattaactgtcctagagctgctggttaccattgaaaaaccaatgttgcactttacataagctctcatcagagtcttttcctctgccctccccaagtaaatcccactgtgaggccactcccatgctgcatgcacagtgggatcattgcaaatttctacccacttcatgtctcaggagaggggaaggaaagatcttatggcaagaaatcggaagattacagtgatttcaatatgagaagaacgtcttcatttcacttcattcaaaatcaaaatgttgcttataattttctatcagcttgataacaattcaggcccacagtgaattataacaagacatatatcttgggaaatatatcactaaaattctgaaatagatgggttccactgttttgttactctacagcacttgcaaaatcgtccttggtatctaacaaacatggattcaacatttttatggcttgtgaaattaaattctctatttcattttagaagtttgatataatgaatttccaataacagcagcagggcaaattccatctggaattccttgttatgtccctgagaagatgattcagtttcaccccttgtgccccatggtggggaattcttcatgggatattatacaagaggctcaatatttcgttccttttttcttttaacagcaaagcatacatcagtctactacctttgcaatatgtttcccaagcagacacatgaatgcagcttgcttctaaaagaggagtgccttcatgtccttgtacctttccctgcagctttattactggtgagatgtcagcaactagcttttcaccaaaagcaatgtttaaagtgagacctttgctatgttaagttttacaaacagctttaatttccgatagctaatgttaagagcttgtggtaaggaaaagaaaaggggaacttgcggaatttcatattttgatcactgcacaggcatcaggaagatgtgttcctatgccttcttcctgctcctggctttctgcttgtcaccttgtagtacaacctcctgtctctctcctccatcgctccctcatctcccctgcctctgccctctctgtttgctgccatctatctatctatctatctatctatcatctatctatctatctatcttttatctatctatctcactttctttctctctctccccccctctttcctgcatcgtttcagtcctccaactggcttttcattccatccttctcctatccatgatttctccttctgtattccaggtttgagactctttcatcactttgctctcccacacacatctctggctgtttccccactaccgggaaagccaacatgtgggaagatcatcagtacatacacatatccaccagtctctctgtcaggccattcattttttccatttggtttttcaactcattcattcattcactcattcatgcctccaataaacatatttgagattctaatatataataggcactggactatgcaggcccttaggatatacagtggagaagaaaacagacaatgatactttcaccctggggctttcactgcaatggggagagagatgtttcaaaaagaatccctctaaaactatgtatcattatgacatatactgggataaatggtatagaggaagtttccagagcactaagagaaagtaaaagagaaaaaataatttaaattgagggtgaagtgttttgtggccagaaaatgctatcatgaagaagtgacatttaagctgaggacttggaaatatgcatgaggtagacaggtgaacagcaaagagggttaccagttcaggggtattggaagcaaaactataaagtcagtcactaaaaccaacaagcatggcttcaacaggggattaagagaaggtcagaataattcaagcaaggggagggtggggatatgttagggtcagagggttgagaaaatcatttccagctcatatcactgttcttgccattctgttaggcaaggcccccatcttcttgccattcatttatttgatcctttttgtttacattctctactcccactgtgcactgctcatctaaatgtaccattctaatatgtttattatttatcatttttcttatgtgataaaaacacaaaatgtgagctttgtaggggggcggttccaagatggccgaataggaacagctccagtctacagctcccagtgtgagcaacacagaagacagttgatttctgcatttccaactgaggtactgggttaatctcactggggcttgtcagacagcaggtgcaggacagtggatgcagccccctgagcgtgagccgaagccgggtgaggcatcgtctcacccaggaagcacaaggagccagggaattccctttcctagccaagggaagctgtgacagatggcacctggaaaattgggtcactcccaccctaatactgtgcttttccaatggtctgagcaaatggtacaccaggagattatatcccgtgcatggcttggagggcctcatgcgcccacagagcctgtctcattgctagcacagcagtctgagatcgaactgcaatgcagcagcaaggctgggggaggggcacccgccattgctgaggcttgagtaggtaaacaaggcagccgggatgctcgaaatgggtggagcccaccgcaaatcacggaggcctgcctgcctctgtagtatccacctctgggggcagggcatagccgaacaaaaggcagcagaaacctctgcagacttaaatgtccctgtctgacagctttgaagagagtagtgcttcccccagcacggagtttgagatctgagaacagacagactgcctcctcaagtgggtccctgacccctaagtagcctaactaggaggcacccccaagtaggggcagactgacaccccacacagctgggtacccctgtgagatgaagcttccagaggaacaatcaggcagcaacatttgctgttcaccaatatccactattctgcaacctctgctgctgatacccaggcaaacagggtctggtgtggacctccagcaaactccaacacacctgcagctgagggtcctaactgttagaaggaaaactaacaaacagaaaggacattcacaccgaaaccccatctgtatgtcaccatcatcaaagatgaaaggtagataaaaccacaaagatggggaaaaaacagagcagaaaagctgaaaattctgaaaatcagagtgcctctcctcctccaaaggaacacagctccttgccagcaaccgaataaagctgcacggagaatgactttgacaagttgagggaagaagacttcagatgatcaaacttctccaagctaaaagaggaagttcgaacccatcgcaaagaagctaaaaaccttgaaaaaagattagatgaaccgcgaactagaataaccagtgaagagaagtccttaaattacctgaaggagctgaaaaccatggcacgagaactacaggatgaatgcacaagattcagtagccgattcaatcaactggaagaaagggtatcagtgattgaagaccaaatgaatgaaatgaagtgagaagagaagtttagagaaaaaagagtaaaaagaaatgaataaagtctccaagaaatatgggactatgtgaaaagaccaaatctacgtctgattggtgtacctgaaagtcacagggagaatggaaccaagttggaaatcactcttcaggatattgtccaggagaacttcctcaacctagcaaggcaggccaacattcaaattcaggaaataacagaggacatcacaaagatactcctcgagaagagcaactccaagacacataattgtcagattcaccaaagttgaaatgaaggaaaaaatgttaagggcagccagagagaaaggtcaggttacccacaaagggaagcccatcagactaacatctgatctctcggcagaaactctacaagccaggagagagtgggggccaatattcaacactcttaaagaaaagaattttcaacccagaatttcatatccagccaaactaagttccataagtgaaggagagataaaatactttacagacaagcaaatgctgagagattttgtcaccactgggcctgccctaaaagagctcctgaaggaagcactaaacatggaaaggaacaacctgtaccagccactgcaaaatcatgccaaattgtaaagaccatcaaggctaggaagaaactgcatcaactaaagagcaaaataaccagctaacatcataatgacaggatcaaattcacacataacaatattaactttaaatgtaaatggactaaatgctccaattaaaagacacagactggcaaataggataaagagtcaagatccatcagtgtgctgtattcaggaaacccatctcacgtgcagagacacacataggctcaaaataaaaggatgaaggaagatctaccaagcaaatggaaaacaaaaaaaggcaggggttgcaatcctagtctctgatataacagatcttacaccaacaaagatcaaaagagaaaatgaaggccattacataatggtaaacggatcaattcaacaagaagaccaaactaccttaaatatatatgcacccaatacaggcgcacacagattcataaagcaagtccttagagacccacagagacttagactcccacacaataataatgggagatgttaacaccacactgtcaacattagacggatcaatgagacagaaagttaacaaggatatccaggaattgaactcagctctgcaccaagtggacctaatagacatgtacagaactctccaccccacatcaacagattatacattcttctcagcaccacatagcacttattacaaaattgaccacatagttggaagtaaagcactcctcagcaaatgtaaaagaacagaaattataacaaactgtctctcagaccacagtgcaatcaaactacaactcgggattaagaaactcactcaaaaccgctcaactacatggaaactgaacaaccttctcctgaatgactactgggtacataacgaaatgaaggtggaaatgaagatgttctttgaaaccaatgagaacaaagacacaacataccagaatctctgggacacattcaaagcagtgtgtagagggaaacttatagcactaaattgcccacaagagaaagcaggaaagatccaagactgacacactaacatcacaattaaaagaactagagaagcaagagcaaacacattcaaaagcaagtagaaggcaagaaataactaagatcagagtagaactgaaggagataaagacacaaaaaaacccttcaaaaaatcaatgaatccaggagctggttttttgaaaagatcaacaaaattgatagaccactagcaagaataataaagaagaaaagagagaagagtcaaatagacgcaataaaaaatgacaaaggggatatcaccaccgatcccacagaaatacaaactaccatcagaaaataccataaacacctctacgcaaataaactagaaaatctagaagaaatggaaaaattcctcgacaaatacaccctcccaagactaaacgaggaagaagttgaatccctaaatagaccaatgacaggctctgaaattgaggcaataattaatagcctaccaaccaaaaaaagtcgaggaccagatggattcacagccgaattctaccagaggtacaaggaggaactggtaccattgcttctgaaactattccaatcaatagaaaaagagggaatcctccctaactcattttacgaggccaggatcatcctgacaccaaagcctggcagagacacaaccaaaaaagagaattttagaccaatatccttgatgaacatcgatgcaaaaatcctcaataaaatactggcaaaccgaatccagcagcacatcaaaaagtttatccaccacaatcaagtgggcttcatcgctgggatgcaattctggttcaacatacacaaatcaataaacgtaatccagcatataaacagaaccaacgataaaaacaacatgattatctcaatagatgcagaaaagatctctgacaaaattcaacagcccttcatgctaaaaactctcaataaattaggtattgatgggacgtatctcaaaataataagagctatttacaacaaatccacagccaatgtcatactgaatgggcaaaaactggaagcattccctttgaaaactggcacaacacagggatgccctctctcaccactcctattcaacatagtgttggaagttctggccagggcaatcaggcaggagaaagaaataaagggcattcaatgacgaaaacgggaagtcaaattgtccccgtttgcagatgacatgattttatatctagaaaaccccatcgtctcagcccaaaatctccttaagctgataagcaacttcagtaaagtctcaggatacaaaatcagtgtgcaaaaatcacaagcattcttatacaccaataacggacagagagccaaatcatgagtgaactcccattcacaattgcttcaaagagaataaaatacctaggaatccaacttacaagggatgtgaaggacctcttcaaggagaactacaaaccactgctcaacaaaataaaagagtacacagacaaatggaagaatattccatgctcattcagaggaagaatcaatatcataaaaatggccatactgcccaaggtaatttatagattcactgccatccttatgaagctaccaatgactttcttcacagaattggaaaaaactactttaaagttcatatggaaccaaaaaagagcccacattgccaagacaatcctgagccaaaagaacaaagctggaggcatcacgctacctgacttcaaactataatacaaggatacagtaaccaaaacagcatggtactcgtaccaaaacagagatatagaccaatggaacagaacagagccctcagaaataatgccacatacctacaactatctgatctttgacaaacttgacaaaaacaagcaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacctaagcaataccattcaggacacaggcatgggcaaagactttatgtctaaaacaccaaaagcaatggcaacaaaagccaaaactgacaaatggcatctaattaaactaaagagcttctgcacagcaaaagaaactacaatcagagtgaacaggcaacctacagaatgggagaaaatttttgcaatgtactcatctgacaaaggcctaatatcaagaatctacaaagaactcaaacaaacttacaagaaaaaaacaaacaactccatcaaaaaatgggcaaagggtatgaacagacacttctcaagagaagacatttgtgcagccaaaaaacacatgaagaaatgctcatcgtcactgcccatcagagaaatgcaaatcaaaaccacaatgagttaccatctcatacctgttagaatggcgatcattaaaaagtcaggaaacaacaggtgctggagaggatgtggagaaataggaacacttttacacagttggtgggactgtaaactagttcaaccattgtggaagtcagtgtggcaattcctcaaggatctagaactagaaataccatttgacccagccatcccattactgggtatatactcaaaggattataaatcatgttgctataaagacacatgcacatgtatgtttattgcggcactattcacaatagcaaagacttggaaccaacccaaatgtccatcaatgatagattggattaagaaaatgtggcacatatacaccatggaatactatgcagctataaaaaatgatgagttcatgtcctttgtagggacatggatgacgctggaaaccatcattctcagcaaactatcacaaggacaaaaaaacaaacaccgcatgttttcactcataggtgggaattgaacaatgagaacacttggacacaggaaggggaacatcacacagcggggcctgtcatggggtgaggggaggggggagggatagcattaggagatatacctaatgtaaatgacgagttaatgggtgcagcacaccaacatggcacatgtatacatatgtaacaaacctgcacattgtgcacaggtaccctagaacttaaagtataataataataattataagagagctttgtagaggctagctatttttgaaaattaaaaaaagcaaaaacacataatgtgtgacatgtgttcttgttttacgtaagattatttttagatatatcattatgcatattatataatatgatatatagatagatagggatatcccatactgtgtctattttttatttttttcgagatagggtctcactctgtcaccccagctgcagtgcagtggcatcttcttagcttactgcagcccggaactccttggctcaagtgatactcctgcctcagtctcccaagtggctgggactggaggcatgccccatcacacctggctaatttttaaattttttatagtgactggggctcactatgttggtgaggttgatcttcaactcctggcctcaagcgatcttcctgcctcgcccccacaaagtgctgggataacaggcgtgagccaccacgcccggcttctttacatctttattaattataatcgacatatgttagactgagcatatttaacatatatgatctaataagttttggtatcacacctgtgaaacaatcattatagtaatgataatgaacacctgtattacaaacaaaaatatatcctcgggctcctttgaaattccagaattttaataaacgtaatcttactccctgcaccctttttttttggtttagcttctttcagagagcatattttcagatgcgtttatgttgtcataagtatcaacaattcatttctttttaatgcgctgtagtattccgttgtatggacatagcacaatttcataattcatctccctgttgatggacacttgggttgtcttcaggcttttggctattacaaataaatttgctatgaatattcataaacaagtaatcatatgaaaatatattttcttttctcctgtgtatgtcttggagtggaatggctggtttatgggaggtgaatatttaactgggtaagcgactaccaaaccaatttccgaagtgtttccatcattcagaagttccacatcattgctagcactgggtataatcagttattttaatttcaatcatgctcatgtatctacgacagtatttaaatttgattttaatctgcatttcctgaatgataaatgatggtatctttttgtgtggttgttagccatctgtgtatcttctttggtgaggtagtctgttgaagtcttttctccatatttatagttgagtatttgccttcttataattgagttataagacttctttatagtctagaagtgtcctgtgttggatatagatatatgaattctaaatattttatcacagagtgtggatttctctttcaatttcaaaagaatgccttttaaaggccaaaaactttaattgtggtggaatcaaatgtattaatttttcttcttttatagtttgtggtttgggtgtctcattttgaaaatctttgccaaaaccaaaaagatgaagaaagttgtaatttcctcaaagagggcattacataagggtaaagggttcaattcaacaagaaggcttagcaatcctaaatatatatgcacccaacaataggagcactggcacctaacaacaggatcattcagattcataaaacaagttcttagagactgacagagggtcttagataaccacaaaataatggtgggagacttcaacaccccactgacagtattagacagatcatcaggcagaaaactaacaaagttatccgggatctgaacagtatgcttgaccacatagactgaacagactattctacaggactctacaccccaaaacaacagtatctacattcttctcatctgcacatgaaacatactgtaaaactgagcacacaattggccataaatcaattttcagcaaaataaaaacaaaccgaaaaattaccaaccaccctctcagaccacaatacaataaaaacagaaatcaatactaagaagatcatttaaaaccatacaataacaaggatattaaacaaactgctcctgagtgacttttgggtaaacaatgaaattaaggcagaaatcaagaaattctttgagattaatgaaaacaaagctaccacataccagaatctctgggacactgctaaagcagtgttaagaggaaagtttttagtgcaaaatgcccatgtcaaaaacttagaaagatctcaaattaataatctaacatcatacctagaggaaccagaaaaacaagagcaagccaaccccaaagctagcagaaaacaagaagtaacaaaaatcagaacttaactgaatgaatttaagttgcaaaaaaccatacaaaagatcaatgaaaccaggtgttggttatttgaaagaaaaaataagactgataaacccctatctagactaatttttaaaaaaaagagagaagatcctaataaacacactcagaaatgacacagtggacattaccaccaaccccagagaagtaccgaaaaaccccagagactgttatgaacacctgtatagacacaaactagaaaacctacaagaaatcaataaattcctcccaaatcaatcaaatacaccctcccaagatggagccaggaagaaattggttcctgaacacaccaataatgagctctgaaattgattcagtaataaatagcctaacaacaagaacaacaacaaaacaactacaacaacaacaagaaaaaaggacccgaggaattcacagctaattctaccagatgtacaaagaagagctggtgctattcctacagaaactattccaaaaaaaaaaaaaaaaacaaaaactgaggaggagggacttctccccaactcattctatgaggccagcatcattttgataccaaaatctggcagagacacacacacaacaaaagaaaacttcaggccaatatccttgatgaacatcgatgcgaaaatcctcaacaaaatactggcaatccgaacctagctgcacatcaaaaagctaatccaccacgatcaagtaggctccatccccgggatgcaagtttggttcaacatacggaaatcaataaatgtgattcatcatatacacagatctaaagacaaaaaacgtatggtgatctcaatagatgcagaaaaggcttttgataaaagttaacatctcttcatggtaaaaactctcgataaactcaatattgaaggaacatacctcaaaataatgaaaatccatctgtgacaaacccacgccaatatcatactgaatgggcaaaagctggacgcattctccttgtaaaccggcacaagacaaggttgccctctctcattactcctactcaacattgtactggaagacctggtcagggcgaccaggcaagagaaataaataaagtgtatccaaataggaagaaaggaagccaaaccacctctgtttgcagatgacatgattctatatctagaaaaccccatagtcttggccaaaaagctccttcagctgataaacgacttgagcgaagttgtaggatacacaatcaatgtacaaagatcactagcattcctatacaccaccaccaaccaaactgagagccaaatcagaaaggcaatcccattcccaattgccacacacacaaaaataaaacacctaggaatacagctaaccaggaaggtgaaagatctccacaatgagaattacaaaacactgctcaaagaaatcagagcagacatgaacatatggaaaaacatcccatgctcatggataggaagaaccaatatcattaaagtggctacactgcctaaagcaatttatagattcaatgctattcccatcgaactaccaaggacattcttcacagagctagaaacaattatttaaaaatgtacatggaaccagaaaaggagcccggatagccaaggcaatcgtaagctaaaagaactatactgcaaggctacaatgaccaaaacagcatggtactggtactggcacaaaaacaggcacatagaccaatggaacagaatagagaggccataaataatgtcgcacatctacaaccagcttttttctttttttttttttttgacaaagctgacaaaaacaagcggtgggaaaaagactccatattctatcaatggtgctgtgataactggctagccgtatgcagaggattgaagctggaccccttccttacactatctacaaaaatccacatgagatggattaaaggctttaatgtaaaacccaacaccataaaaaccctggaagacaacctaggcaataccatcctggacataggagcaggcaaagatctcacgacagaggcaccaaaagcaatcacagcaagagtaaaaattgacacatgggatctaattaaacttagagcttctgcacagcaaaagaaactatcaacagagtaaacagacaacctacaaagtgggagaaaatttttgcaacactattcatctaacagaggtctgatatccagcatctataaaaagcctaaacaaatgcacaagagaaaaacaaacaaccccattaataagggggcaaatgacatgaacagacacttctcaaaagaagacatacatgtagccaagaagtatatgaaaaacagctcaatatcactgatcattagagaaatgcaaatcaaaaccacaatgagataccatcccataacagtcagaatggctgttactaaaaacaaaaaatagcagatgctggcgaggttgccaagaaaaggaaacccatatacacggttggcgggagtgtacattagctcaaccattgtggaaagcagtatcgcaattcctcaaagagctaaaagcagaactaccatttgacccagcaatcccattactgggtatagagccagaggaatataaagcattctaccataaagacacatgcacctggactattcactgcagcactgttcacaagagcaaaaacgtggaatcaacataaatgcccatcaatgacagactggatacggaaaatgtggtgcatatacaccatggaatattatgcagccataaagaagaacaaggccgtgtcttttgtgggaacaggcatggagctggaggctataagctcagcaaactaacgcaggaacagaaaagcaaatcccacatgttctcacttagaattgggagctaaatgataagaacttatgaacacaaagaaggaaacaacagacactggggtctccttaagggggagggtgggatgacggagaggagcagaaaagagataactcttggatagtgagttcaatacctgggtgatgtagtcatgtgtgcaacgaacccccgtgacacgtgtttatctatgtaacaaaccttcacatgtacccccaaacataaaagttttaaaaaatattacagtgcaagtctattgatgatcaattctttcaacttctgtatgtctaaacacctactattttaacttcatttgaaaagatattcattgagtatagacttaagagttgacatttatttttatttcacgattttaaagatggtgtgccacatgacttctgacttgcatattgctaatgagaaatgtgctgtcattcttctctttggacatctaaatgtttcttatggttttcttctgattttctagttacttaggagaaagggtaaatctctgggcgagcagataggtaaaatgtcaggaatgcacaccatggattctctgtgcatagcaccttggacatactttagattatgcgtggcaacgtggaggcctcctgaaagcacagggctcagtgaaaagaaaattaagaaatccggtggatacttgtatttccagccatgatggattaacaggaaccggacttaccgtctcgcctaaatacctataaaccaaaaaaattataaggcttaacgtcatggcaccacctgcatacgggacagtgatccctgagagaaagggaacctgaccaggtgagccctctgatcgcccaattccaccaacttcttgcccggatagagtttgcaggctgcagcacaggggagctgaacacaacagagcccggtggaccgtctgagtgaaggagacagagttgagagctcaagaggtccataggaccagaatttgccgggagtaatggagagaagacagctgcacagagaggcagctctggagacccttcagagcttgcccttctggatgcagcgtatcagaaacggggagtggtgatcgatgactcccagtttctggagtgagtggttgtgtggataatggcgccatttactgagactgtgaagatgggttggggggggggggaacaggagcgatggggatgtgtgagtgtatgggaggagtgagtataccaagtgaccagttttggacaggcaaaccatgaagagcccttgagacttccaagtggagatgccacgtaggtgggtgaatgtatgtacttggacctcaaaagtgaagttcagactggggttgtagattttttggagtgattagcacgtagcactttctgaaggctttcgtttgtagggtgtgttcctctcccgcagaggatatgttacaggggaagggctaaagaggcacaagcagctgacaggagagattgatatataacagctggagaaaaccacagagccaggcagaatggatactggtcagcggagagtaaaagctgctgtcctagcaataccttccattcatacacaggggtcctggtgaggctgacataaaaacaaatataaaaatctactacgaattttacaaacagtccaggttcgactgcagatgagaccacagcattttctgcctcaaaagacatccaagtggagatgtcacgtaggcaggtgaatgtactatgcacttggacctcaaaagtgaagtttgaactgggcttgtagattgtggagtaattagctcagacacacaggtgtctaattgtcctggcggacaccaggagggtctcagcggcagcgtgattgtatcgctgataaggaagaggcctgacaatctgagtagagagtggacccggtggagcaattctcatacctggatggacccacatagagccgcagaggctgggggcgaggcggggggaggctctgtctccctgtgtcctgaatgcggagcatgaacttaggccttctacagcacaaaccttgcttctttgggacagatgttggggtgggggaggcctgtcactcagacggaggaggcggtgcctctgtccccaggccagcaggagcaggaggtggactttggagtccggaagacccaggttcaaattttgcattttctgtttcctggctctgtggtctagttcatgcaatgtgtctgtgcctcagcttcctgacacgccaaatggggatgctgacatccacttcccagcgctgctgtgagaggaagaaaagccccagcacagatccctctgtgacatacaagctgcataaagggtagctgaggaagcagatgttcccagtatgtctgggggccagagagttggctagtggagaagcacacaaagcgaagtgccatcctctggccatgtccatttcgtagccccgcaggttgaggatttccacttgttgcagttagagacccagcttattaattgtgagacctcactaattgtgacctaaggggtcttgccggggaaacggggcatagtgtatcccagaccaggctggaggagtttgggtgaaagggcagggcaggacagagaagcattgtgcaaaagtggggggactgagaagagatgattgggtgggtcgagctgcactgcagggtatgagtgtgcgcgcccgcggtaggaggaggaggaggaggagaggtgaagtggatctggcgggaagagccccccgcaccctaccttcgaccccaccgcccacccacccgcggaatcgcatgcgcactggagacctggaggaaagggcttttgttgggaaagcgggcgggctggaggggtccgcgcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaatttggatgtttcttcctttacctgcacacccattgctatacctggccacgcttgggcttgtagcaaggaaacttcttcaggctctctggggtaggtgggccccacctctgccaaaaaggcccacagggacaggtgggatgctgggaggtgcggaggttggttacgcctgagtgcgtgagcaggagtttggagaggccccagtgctcatcgttatgtgattttctacaaaccttgctcagcagccccagggacatggcaagagtcggggccacagcaggggcggggtggaaaattgcagcttggtgccactgcccctcccgccgagggacagggtccaaggctctcaccaggacccacctcccacaccccctccttggagatgatgttccggaacccttggctcatcatccacacagttcaggaccccgtcctcggtacagagtctgacggacaatgaggtgggccccgcagtgatgttcgcagccctccagtgggtagaaggaggggccgtgattgctgagggagcaggatgtaataaaaacaacgcacggtgcacgcgtacacagccccttgcctgtgacggaacggcggcctgtttggagcttcgcagcccttctcccccagcagcagggctctcccagtgaggacaacaccaggcctacctaggtcctggtgtgttcaagggctgggtgatgtctggaggggtctgaggtagggctgcacatgcttcaggtacaagacagtgagggcagagacagtttggtctcctgggaagggctcagtggcaggcagggacagtgtccagggcttctggagttccccggtaatgtccagggcttgggaggacagagccctagataaggagggaaaacatagcagtggaaggctccctgcttcccaccccctcacccagccccagcctctgtttccccaggaggggctgccatctccgccacggccagatcctgacccagaccgggctacctaatttgggaggcccagtggaaaatgaaaacacgagtctccttgtcaaaaactatgaaggatttcaaaacaacaacagcagagcatggagccacatggggagccctggtgagcatcagactgcattggttgcacaccccagaagctgtccgtcagaaaggctttgggtgggtctccgtgttggctgccgctgtgatttctgcttctctggtgcttgggtccatgcttggccacactgacattctgggactctgacagaaatccagttccaaagttttactggaacacacacacacacacacacacacacacacacacacacacacacacacaatggagtccccttccctttatgtctcctggtttgtggtctgggctgtggaagagatgagggatgcctgggactccaccacccctggcgtcataaatttaatgctatttggctggaacctccccggacacccttgtgcacatagcgggcacatgcctgtccttggatcagggtgggggtagtcaccataagccacaggagtgagtttgaacactgtgtgcagagggcacttgagatacggaagttccaccggaaaggaacaggaagcagccctcagaggtggggtgctggccaggtcacggcctcctcaggcctccaggcttgctggacactctccctttcacatcaccttgctgcggtggggcctcaccagggacccactccccctaccctgtaggggcagcgctgagagcacctgggaagagaggaggagagcagggaggtgagagcaccctggtgggaaatgggggcggactggactgcgcgtcctgcagaagggtcagaccggccaccctggagacggccaccacctcactcacatggcaaacaggagacctaggcaggtttcccccctgcccccggcctggggccttctgcagaccccgcactgcaaaggcccacagtccatgtcagcaagtgttttctgaggccctgctgtgtcagtggacagcactcacagccttctcccagcttggcctgctccctctgatcacccctgccccaggcctggcgatggacgagcattcgtgcattcacttgtttccagttattgacattatgcataaagttgttctgaatattcatgtacaatttctcatctgggcctatgtttctgtttctcggccaagcccgagaggtgggggcagtaaggccatttcatggtctcagccaactgaggctccgagagggaagacgctctccccaagtcacacagccaggaagtggcagagcacagacttgaacctgggaccctctgaggccagggtgcgtgcactgggccctgctgtcggcctcccctgccatccagggtcttgcagtgtcctgggggtgatacacccacctgctgggcactctctcctgacacccaccctcgcacccacgtgcacataccgctccccatctcccttcatcgtgcatgattcgctacccctcacggcttccctgaacgacaggttccaccctaggtttctgaggcctgccaccgccctcccagcctcctgagacatcaggttgggtgctttccttcctgggcatccatcctgctgctcctccttgtttttgtcgtcatcaggccctgggccaagggcgttttgcccactacctcgtgacaccctcaaagatcgtctgagctactactgtgcacttgaggaaacagactcagagaagggaggtgacttgcctgagatctctgacccagctttgccgctgcctccactagtgaccttggcccagcctcttctcttgaccagttgcatatcgttccgtgttgcatgtgaagaaccattcacatggtttgcacattgattatcatttgtcgtcttaatactgaattataagagtgcttttttgcgtgcaaacttttccattgtcgggtagtatatattgcaaacattgccgcaatgaatggtttgctttttcatttcgctaatgatgaaaagccagatttctaaatttgatgaaattcacttaaggtgtttttgcatggctattgctttctgtgtcatagctataagagtccttcgcctacagcaagtttttcaaggctttatcctgaattctcttccagaggtcttatgctttagcttttttgttgacatttaggatcttcacaaacttcagaagtttgaaatcataccaattatcttttctgaccacaatggaatgaaactagaaagcaataccggaaggagaattgaaaaagtcacaaacaggtggaaattacaacactctcttcaacaaccagtgggtcaaagaacagaccacaaggaaattagaaagtatcttgagacacatgacaatgaaaacaccacataccacaactaaggagatgcagggaaagcagtgttaagagggaagtttattgtggtaaatccttacagtgaaaaagaagaaagatctcaaatcaacagcctatctttgtgtttcgagaactagcaaaggaagaacaacgtaaacccgaagttagcagaaggaaggaagtaataaagattagagcacaaataaaggaaatggagaatagacaaataataggaaaaaaaaaaacaatgaaactaagagctggtgtctctgaaaaggtcaacataggttaagcagattaagaaaaaaacagagaagggtcaaataactaaaatcagaatgacagaggggcattacaattgttactacagaaataaaaaagattataaggagaagaccaggaacaactataccccaacaaatttgatactttagaagaaatggataaattctgagaaacgtacacgctgccaagactgactcctgaagaaataaaaaatctcagcagatctcgacaactcataaggagacttaaccagtattcatcaacctcccaacagagaaaaccgcaggactagatggcttcagtggagaattctactaaacagttagagaagaactaggaccagaaacgcgcgcgcgcacacacacacacacacacacacacttcccaaaagaatgtttgtgcatacatattcaacaaaagtctagcacaccgagttcaacaacacatgaaaggcccatgaccacgtgggatttattcgtggaatgcaaggaagtttcgatcaatgaaaatcaactaatttagtgtacggcatcaacaaaatgaaggacaaaaccacatgatcggctcaattgatgcactaaaagcatctgacaaaagtcaacccccttcgtgataaaaacactcaaactccttgaaacagaaggaaacaacctcaacgtcacaaaagtcctatataaaatactcattgtgaacactgtacacgatggcgaaagagtgaaagcttttcctctaagatcaggagcaagacagagatgcccgcttttgctacttcttctcaacatagtcccggaagttcagagggcaattaagcaagaaaatgaaataaaagggcatcctttttatttcacttcattttatttttagaaaaggcatcctttttatttcctattttctaaataacccatagctcaaggaaaacatcaccaatgaaatcgcaaagtattttgaacctgatgaaatcttatgggatatattttaattgtctagattgcatgaaaaagaaaggcacaacatttgcatctttcttaaccatgttgaacaacagattaaacctgaagaaagcagaagaaatgaaataacgataaaagtacaaatcagttaaagataaaacaacacagccagaggtggttttttgaaaagatgatgtgattaagacatgccttgtgtaggcctgaacaaaaaggagagaaatcatgaagcaacccgtgtctggagtggctaaggagacatcactatgggcaatgaaggcattaaagagatcattattcaaaaccatgagcaactttatgcccacaaacgtgaaactttggatataatttacacatttcaagaaaatacaacaaaatgacagaaaacagactaaacatctgaattgtcctacaaattctaaacgggcggaatctgaaggaaacaacagcaacagccacaagaacctacggactctgatgctgccaccgattaattctacaaaacgtttgtgaaggaaggaatatcaatcttaccttcttgccaagtaacataaaaaacgggaaatgcttcccatcccgttttatgagggaaaaaccttaaagggcatggtaagaaatgaaatgcacaggcctatcttttacataagcacagaagaagaaatcttgaataaagcattagcaaaacaaatcagttaaatctccaaaaaggaaaacgtatcacaaacaagtcaagagtattctagaaatgaagcggttcagcgcttgaaaaatctatctctcagaagtaatgtatgaaggagaaaaaatatgatattccctacagacgcaggaagggtatttcatgggtttgattttttttaaatgaccatgcacttatgataaaacctcttagccaactacgaacaaaagggaagtctcttgattccgttggaatatattttaaaagcctacaaaaacaacgatacttacgggtgacatgttgacagctttccctctgagatcagggggaaaaaaaaaccagatacatccactgtcaccacttacagtgccatgaaggaagaaaaagtaatcaaagcagtcctgcaagcacagccttaaatgcatacgcatgttaaccaaaggacatccttgtgaacgtgcaccacaataataacactaacactccagcgctggaaactactgaagagcccattagaaataaaaggcatgaataaattgtggcatcgtcatacaattcaaaacactgcgcaggaatgcaaagaaacgaaattcagctacacagcacgacaaaagtgaatagcaaggagaaaaacctaatgttgccaagagaaacccggattataaaatacgtactgtactgagtctactcatgtgtaatgcgttcacaaacaggcaggattatcgtcaagtgttaaaagtcacaagagtggttagatttgctgaggtggaagacaagagtgactggcatgagagtgcttttgagctgccggcaatacactacaccatttcttaacccagatcgtaggggatcagacgtccctgtggaaccatttactgagtggtaccctcattttgcgtgcaactccatttttgtattatattccattacagtgtacatagagatatttaaatgaatactatcccaggaatgtccataaacaatggattcttcagcgatttgtatattctctgaccacaatgccacaatgggatctagaaattaataacaaaagatcattacaaacccccgtatatgttggtaaattaagaaacatcctcctaagtaacccatggctctaagaaaaactaacgttgaaataagaaaatattttgagcttactaatgaagcaaactccagaggtctttgcctgccaatattactaagtctcctctctggggaagtttagattacacaggaagactctcctgcatctctgagaaggggcaagatgccagcaatctggacgccaaactccagcggaggtgagggactgaagattgctgtagacagcaactgaaatccctacgccgggttgggatgtatgccttgaagtgagcctgaagttccaaagcccataaatctgctggttcatgctctgcagagagtacatttgtccgccatctcccagagtggggggagagcgatttgtcatgctacgaggagctgagaggggatctgggcgtctaagtgatttgtaaatacactttctagagcaatcgtgcaatttacagcccccaccattaccaacaacgtgccgggatacgtggcaatgccagtgttgcagacagttggaaggtctggtgagaggggataagtcagttgctttcctgccatcctcactgccagttgatgctcaagctctcttggcaacacaagtgagactccgtctgtaaaaaaacaaaacataaaaaaaaaattaacatgtactcccagctactctggaggctgtggctggaggatcccttgagctcagcagttcgaggctacagggagctatgatcataccactgaactccagcctgggcgacagagcgagaaccccccacaccctcaaaaaagatcaagctctcttaatcagctaagtcagtgtcactcacctgtttccttcccatcttctgctactttctttctcttgtctcctcagccagtttctttgtctttatggggtaaagccttaggagaaaaggatgcagccaggaaagagggagggggaagagaggtgagaagtgaacgtgagaaagagaaggggtgagtgaagtacatgaccaaaggtgccctggggaagctgggagcaggaacaagggtccccgggcgagttgaaactacccctcatgctctttggtctgttgggtgctcaggttgcaggaaatgggcatccggttggacttcatgagaactcacaccttggggtgtggagggcaggacaccatgagaggagtcccaccctgctgcaaaagatagaagaggagagttgcccccaacataaaagggaaggcagtgacagaaagaggcaagcagaggatggtggatggcagaacaaggactatcatcaatgacattttcttcactgagcccaccccagaaatgagctcccttcctgtgcgctctcacagctccttgtcgttgaatctcgtatcactgatggtaatttgcagaggaataattaagttggtgattcactttaggatgtactgccctccgaggctgaaagctaaacacatagagcccacgttacgcccagtaccacttaaggaactgcggattagtcactgggtgagtatcaggggaggggagggcggggagggtgaggggagggaacggcatagagagaaggaaaaagcaaaatgaggggaaaaccaggggaggacaacatgagaaaggaaagagggagagaaagggcagtgagggatatgggaactcggagggaggacaaagggaaagacaaggcatggaggagagagagcagagaggggagatgagaggtgatgacagaggctgaagtgaggtaggaagagagaggaaagaggaaaggagtgtagaggaaatggatgagggagtaaagagaaaggaacaaggggagaggtcctttaccaaagggtgattgatgagcagggggcaagaagaaggggcagcgagggagaaagggaaaggaggagaaaactgccagctttgagaactctaccctgcccctggaaagaggggatccccatcccaggtcaacctggggctccccatgggactatctcagagggaggagctggataagccaagaaagagcaaagggtgcacgggaccactcttgccttgctgcatgtgtcattcagggccttcccacccaaacagggggactggtcacatcaacagccacctctgctgaatccaagctctgcaccggatcctcctttcccctgccagatacgggtttcaacaagcaaatttaagggaatcactccccttcctgggatccctccctgactgtatcagttgcaacccctttcatggtcacagaggcctggcctctcccacaagaaccctatgggccagccagtgcgatgctctgtacatcgtatctgttcaggatgaagcctgtgtgtgtgtgtgtgtgtgtgtgtgtgtgtgtgtgtatggggtgggggtgtgtgggatgtgtgcgtgtgtgtgtgtgtgtgtgtgtgtactaataatcacaaggatcaatatatctgtgggaattgtgaattctttcaatgtgactgccttgctagaatcccctctcccaggggcctttatttcaaggaccaactctgcttttctcccacagcccaatgaatgcatcagacactcagcttcagttcccatggcaacaggggctaatggcctagagactaaagatgagacaaagagaaacgcagagaaatgtgcgtgttctgtcttcctctgaggtacgcaagcccctattcagggattgaaaagaacattcgctttagttctaccctgccctcccctcaatgctgggtggaggagggcagaaacgcagacgggcctgacatgaatccagaatttctacatcctctcaatgcacctgcacggtttggagacaggcttctttgtccccgagccatcatgttaccaacaatgtattgtacctgcaaaccatgcctgtggaacctaggattcctgctaccccaactcaccttcctctttaccaccctctagcctctatcacagtaggggagttttttcagtcattcctattttctgacagaaagttccagccagcccaatttcagaagcgctgtctcaggagggctccctgatccttcctgccagagtcacacaggacacacctcctccctcttctcctctgtggcctgggagacctctgcccagaccatgggacaagttcctagggctcccccttcctgccacactcctgttccgccagggccttggggagactcagacgagggaggtttctgatagtctcccacttctggaagcagccaaactaatgagaggcctcttgcctgcccctcttcctgagaagcccaccacctcctgtgtattgactccccttaccagaggctggacaaacagcgtgccaggcccgacatgagacgtcccacactataaatttgtgataaacaacaactcaaaagctgggcatatgcccccaactttccctcccttctttccatttattccagtgagtctcagaagtccctttgtccagctgcactctcctctcctgggacccagctgccctccatttcccatgtcctggaacccctcagtccaaaatacctaagtaaactcgtcttcactgcaatgtgcaacccacacccacagccatgccctacgccagaaggaaccacatgaagttctgcccatcttcctgacctccacggatgttgcgcgacatccagtctcctctgggtcagggggtttgtctcatatgcactcctgagtgcccacctgccagtgactcccctgtgtttcacacccctctcgggggatctcagatccactcggctcctggtctctgtctggatgaccacgaccagtttcccttggagaaggaccaatggggaatggcaatgccaggaaggcaacgcttcgcttgactgctctgctccttaaatccccaaaagcaccactcacaggactgtagacgctatgccagttacagacttcagcgaagggtcaatagtgactacatgaaattatagtggaacaaactactagtgagcgatggctaagcatccatgctgctagaatccaaaaagaatcacccatcccctgcctcccacggaaaagataaggtcttctgaggacattccatttccggtgaattcccgttcatggcttttcttcctgttttgagcactgcccttttctctccctggaaagaaggaagtccctccattaatctgcttcattgtagggatttctttatctctcagtaatgggatctgtctatgtctccacctccctgtgaacatgtgaacacccagagacaatcaccaaacactaaggagctatgagtgtcacatcataatccctcacctagctctgcgcagtggctcacacctataaccccagctatgcaagacaccgaggcaggaggattggttgaggccaggagttggacacgagcctggtcaatgtagcgagacctcatctctaaaattataaaaatagaaaaaattagccttatatggtggcacgcatctgtggtcccagctactcgggagactcatgcaggaggatcacttgagcccaggagtttgaggctgcagtgagttatgacagcaccactgcacagagctttgggaggctgcactttgaaggcaggagttcaagaccagcttgggcatcacagcgagaccccaactgcagaaaaaaaataaaattaaatttaaaaaaattaaaaatatctctgaccgatacatttctcaaaatttgaatttgtcagtttacattaaccttcgttactcagcctggatcctatggacttcaaacttcatttcctcatcctctggacatctctgccctgccaatccctcattctcaatttggccatccccggggatggaggttatcagcatggctttaactgagagcatgaagcatggggctggtggctcatatttttaacaaagccagcctctctggttgaccccatctttacccctcactgtttctcacagtttgaattcctgcagatgtccactgtttctctgcatcttcaaattcttctgctccagtggctattcccctcagcatacaattacgctccactgtcctccattttaaacaaataccttcccttggcgacacttccctaccagctgttctcccacatacctgctgcctttcacagcaaaacttttctggtaagttgtctgaacaggttgtcaccacttcctcatctccacctccgatgtcttgcatggccttctgtcctccaatatgctttttttctttttcatgctctttagtaacttacatgatgtcaaatccaattatcatccctctgacctggcttgccctcttagtagcattgaacgtgctggccactatcggtctcttgagatcttgtggattccatgaaaccatcttcttctggtgatcttccttccaggatagatcctattctttgagttgtttcctggctcctcttcttgtaaactcctctactttttgatatgctccagattgtggccttgtttcctccttttctacatttttttctcgaagaaatttcctttcactttacagatgtaaataacacctacatctgccacctcctgtgtccatcagaatgtttggttagcaacaacagaaaaacactcacgattgctcaaccaaaaaaaaaaaaaaaaacaaacaaacaaacctgatgcaagaatatcaggttgcacacgaagtcaataagagggctgcataaccagaattggaaagcaggtaggatccacgggagtctgagacatagaaacaatcacaaaggtcatgcctgagaaatagctttgttttgacattgttcttgcaaccttgctactctgccagagaggccgctttggaagcctcctaccacatttaatttttcagccttatggaagtcttcgtataggtttcgttttgtaataattcaaaaatatccctccaacttgtatcctaatatactagcatgtatgttaacttaggaataagttatgaacattttgaattccttcagagattctttcctccttcattaaaagaaacagctttattgagatataattcagataccacaaagctcacccttttaaagtgtaccgtgcagtggttgttagtatattccaaaagttgagcaactcccattccgtaggtggccttttcaccgtgttgattgtttcatttggttcaccataggtttttgttttcgtttttggtttttgctttcattttattttattttttatatatatatatatatatatatatttattatactttaagttctaacgtacatgtgcaaaacgtgcaggtttgttacctgttggtgtgctgcacccattaactcgtcttttgcattaggtatatctcctaatgctatccctcccccctcccccctccccctacccacaacaggccccggtgggttcaccataggtttttggttcgacttagtctcaccagtctaacgtggctttttgttgcttgtgctttttgtcatattcaagagataatttccaagtcaaatgccatggaacttttcacctatgttctcttctaggagatttacaggaaaagatatttgaaaaggatatatatgataagggattaatatccaagctatacaaggaactcctacaactcaataccaaaaaagaagacaacaaactgactaaagaatgggcaaaagacttgaatagacatttcttcaaagaggacatgcacatgcccaacagtatatgaaaaagtgctcaacgtcactactcagcagagaaatgcaaatccaaaccacaatgagctatcacctcacactttgaatgatagctattatcaaaacaaaaaagaaagaaagaagaaagaaagagaaagaaaaaagaaagagaaagaaagaagaaagaaaaagaaagaaagaaagaaagaaagaaagaaagaaagaaagaaagaaagaaagaaagaaggaaagaaaagaaagaaagaaagaaagaaagaaaagataacaagtgttgttttggagaagatgtgtaaaaattccaacacgggcacactggagtaggcacataaagcggtgcagccactatggaatacaccgtagtggttcctcaaaaaattgaaaatagaacgaccatgtgatctggcaatcccacttttgggtatatatccaaaagaattgaaatctggacctcgaagggatatatgcactcccacctctattgaagcattacatctaacagtcaaaatttaaaaacaatgtggaaacaacctaaatgttcatcgacagatgaatggatattaaaaatgtggtatacacataaaatgggacattattccacttccatgaagaaggaattcctgccatcacacccaaataatgtgggttctaaatatttcagctatctaaaatagtcaaatttaaaaaccagagtgcagtgtcggctgcttgaacctggagggagggggaaacagggagttgctattctatgggtataaagtttccgttgtgccaggtgaatacattcttgagatctcctgtacaaccctgtgcctatggttaagaatatggtattttgcacttaaaattttagtgagggcggatctcatgttacgtgttcttagcacaataaaataaaatttaaaaaacggaaaagttgtgcaactatcacaaccatgtaatttaagaacttttttattcaaaaaacacgctgtatgtatttaagtgacctaatctcccctcttcttcaaaccactggtaccctctgatctatcttctggctctctgattttgcatgtagtgaatgtttcctataaatcagatcatacaatgcgtgaccttttggaccggcttctttcagtaagcactatgttttccagattaatcaatgttgtggctcgtacattccattaactaccatataatgatactacatattggttactcattcaactgtggatggacttttagattctttcactttttggctactatggaggaggctgttatggacactcttgtacaggattttacctgagttattttttgaaatctcttgggtgaacacctggagtggacttgctgggtcataaaggaactcttacttttggaggaactgctgcaccctctcccaaagtgattgggccatcttacaatcccatgagaaatgtcttaagattccagttcctccacaaccttgccaacatttgttattgtctatctgtttgatttcagccatcttagtgagtgggaagtggtatcacaacgtggatttgacttgcacttccctaatgactaatgacactgagcatcttttcttgagcttattagccatttgtacatgttctttagagaaatgtctattgcaatgctttgcccacttttatttgggctgtgtgtcttttttattaggcagtcgtaagtgtttagtagatattgcaaatagagtcaaatatgagatatatgattttccaatcttttcaatcatctcataagttgtcttccctgtccttgatggtgggctttgaagcacaaaagtatttaattttaatgaagtacaattcctctgtgtttcatgtttttcacccgtgatatgggtaccatatctacaaagccaattccaatttcaaggtcatgaaggttatccccaaagtttttttccaaaagttacatagtttttttccccttaggtttatgtctatcattcattttgaattaattttcaggcatggcatgagatggtgggtccacttcattcttctccatgggcataaccatttgtcccagcaccgtttgtggaaaatgctattctttctcactttgagttgccttgatacacttgtggaaaatcaactgaacttaaaagaagaggtttatttctaaaatttgcatttttatgacactgatatatatatgcctaaatttatgccagtaccacaacacattgattactgtagctttgcagtaagttttgaaatagagacgtgtgagtcctccatcattgctctttttcaagattgttttggcttttctgggtcccttgcgttgccaagggaatgtcagaatcagattgtcaattatggcaagaagatcctggtgggatttgaaacggtgagtatgttgtatctatagatccacttgtggactgttactattttaatgatacacagtcttccccgtccatgtgtaagggacaccttcacatttctttaggtcttctttaatttctttcaataaggttttgtagtgttctgcgtacaagtcttacacttcttttgtggaatttatttctaactattgtgtttctttggatgctatgataagtggaattgtttttaaagtgtcctttattggattattcattggtagtacaaagacataaaattgtatgttttacattgatgtagatattatatggaataaattcaatgactcgtcctgatagtattttcttttccggcttctttagtgttttctatgtacaagataatgtcatctgtgagcagagagagttttacttattcctttcaagtctggaggtcttctatctctttttcttgcctaaatgcattagctagaagctcctgtacaatgttaaatagaaatggtgagagcacacattgttgcttgttgagggtgaaagttttcagcctttcaccattaatcatgatggcagttgtgagtttttggtagagtctactgagttgcagaagcaccttttttctccagtttcttcatatttttttaattgtgaaacggttttggatctgtcacaagttttttctgtgtctacggaaacgataatatggggtttttatttggttagtgtggtatattatattgattgatttttgtacgttgaaccaactttacattcctggagcaagttccacttggtctttgtgtaaaatctgtgtgtgtgtgtgtgtgtgtgtgtgtgcacgtgtgtgtgttgctggattaggtatgtgtgtaatttgtggaggagatttgtgtatacataacagatatgcatctgtaattaggttagttatttccttctgatgccttgtctaattttggagtttggttaaagttgggctcgaaaaactagctgggaagggcgcccttctgttcttgagcaatcttgtgaagctttggtgttaagtgtcctttaaatatttggtagaattccaccagttaaccctggacttttctttgggggaatatatttgttagtaattcaatccctttacttgttgtaaatcaattcaaatcttctacttctcctttaggcagtttcagtaatttgtgtgtttctggacatttgtccttgtcacaagattatctaatttgttgccatgctgttgttcacagtatttcccataacctttttatttctgtaagattgtattaatatcctatattctagttttgatttttgtaatatgcatcttttctattctttcttagtctagcaaaagcatgtcaatttcgttgatctttgttaatgaaccaacttttggtttggttaattttctctattatttcctatattctttttatttatatcactctaacagtccttatttccttccttctgcctgtttggggttagtttaattttcttgctcctgtgtcttaacataaaaatttagaagaattttttgagagcactactcttttttcaatataggtgtttatagctatacatttgcatctaagagctaatttagccacatcctacaaggctgggatcttgtgtgcatctttctcccttcagttgtgtccatttttgcttcgtgtattgtggggcactattgctatgtgtctatatatttttataaaaatctttatatcttcttgatggattgagcactctaccgtgataaaacgtccttctctgtatctaaatcgaattgttgtcttaaagtatatttttgtctcagagaatattagtagagccactccaactctcttttcatgattgtttccacactatacttttccacgcttttattttaagcaatttatgtctttgaaagtaaagcacacctcttcaagatagcatgtaactggagcatttaaacaaatctgttctgccaatctctccttttggttttgttgagggcattttcttctacatttataaaagatattgttctgtagtatgctcttcttgggatgtcctcttctgcctttggtttctgggtaatattggtctcatagaatgacttcagtgaatttgagcaagttacctaactttcatgaacctcaaagactaagaggaatgtgaatgggctgagtctggaaggtcttcttttctctaagcagtcttctccaggtggtggtggggcggaggcacctgctaggagtagaatgaggagtggatggatagtggggtcagatatcatcctgtgcaccccttatctcccaggtcctcccttcaccttcctgcccatcctctctccctccccatttacatctaccacaaggaattcgaaggagtttgcagaactttagatgaaatttctctttctccaacagtggattggataagaggcgcacaaaatatttccgaacccaaatatttttcagagaacataggatgatgaagaaacaatgtgccgttgaacttctatactttcttccacacagtgaaaagcatatttagtctttacagtgggtaataaaatccctgagtccagaaaatgaaacctgggggaacgaagaggcttcactgaggcttcagtattttggcaatcttcatagccaaggaaaggcttgctggggcactaggagcaggactgatggctgtagaatcacacagcatacagaatggaagatcaggcttcctcttaccacgggaactcccaatctggtttgaaaaatgggacccatacatgacattattcaatacaacgaaaggtgctatataagctgaagagccttcgaaaagatggacgagaattagtcactgccattgagaagttcagagtccggtgggagagataaggctcatagacaatgatacttatcatagtgaatattacctttcttacaggaacaaagaggagggaagaaacaacttcctgagggagtcaggagcacttgctccaagtttaagcgatgaattgcaggttatcaaccatcaaagctgtggcaatgacattctgggaagaaggaacagaatttgcaaagaaggaagcttatttgacacacattttttgagagctctgtcttccccaaatagtgtgcaagttttgagagctacagaggaaatgaacaatgcctctgtccagatcactaatgaatccatgtaccctgaactggcaagggaaacattcacaagccggttctcatcattttaaaaggtataatgactccaaggatgcctggggaaggccatctcgtcatccggtcaggtcccccacaggggaagtcagtaccatgctatgatcaccgttattcccagttttgtaggtgcagcaattaaacgttgtccacacatccagagggaattgggctacagaagactgcctcacattgataaaatttaccaaaattatacccatatggtacacaaaatgaggtcaggtgcatcatttgaatgaaacattgacaattttaaaacacattaaataatttttcctaaatggtacattttgcctcacgtttgttttttacagtaactttctatttatgacaagtcatgttggatttccacttatggtagtgatattaagtttcctttgaaaatatacttattgatgaaaaactattttgttcaaaggaaaacactatgccttctaaacacgacaatgaagatagcgtgtgatattaatgaattaaaattctaaacaaactataagaaatgcaagtgaaatattaacgtagatcggaagcatttggtattataatagttttaccacaattaaatatcgcaaaaagagtgaaggtggtaaacggatgattactgaaatcagggaccaactcgaattttctcccagagtccagtgaatgcgtcagacactcagctttggttcccatggtaactaggactaatggtctcaggactaagaatgagacaaagagaaacacagagaaatgtgcacattctgtcttcctgtgaggtacacaagcccctattcagcaaatgaaaagaacattcactttagttctgccctgacctcccctcactgctgggtggaggagaacggaaaggcagagggatccaataccaatcttaagcgtttacatccaggcttccttgtcccttagccaccatcttaccaacaatgtgttgtacctccaaatcatgcccgtggaatctaggattcttgctatcccaatccacttgccctgttccccacccactagccgctatcataatatgggaggttttcagtcatccccattttatgtcagatagttccagcccgatttcagaaatgctgccccagaaaagttccctgacccttcctgccagatcgcacagaacagaactgactccctcccttttctcctctgtggcctgggagacctcggcccagatcatgggctcccacttcctgccacactcccattccaccagggcctggggggagacccaaaggagggaagtttctgacagtctcctgtttggggaagcagccaaactaatgaggggcctcttccctgtccctttttcctgagtagctatctcctttgtattggctccctgtatcagaggctggacaaatagggttccaggcaggacatgacacattccacaccataaatttgtgaagaaaaaacacacaaaagctgggcataggcccccaacttcaactcccttccttccatttattccagcgagtctctgaagtccctttgtccagctgcactctcctttcctgggacccagctgccatttcccatgtcctggaaactctcggcccaaaatacccaagtaacttcattgtactattcctttcttgcattgctgtaaagaaatacctgagactgggtaatttataaagaaaaaaggtttaattggctcacagttctgcaagctgtacaggaagcctgattttggcatctgctcggcttctggcaaggcctcaggaaacttgcaatcctagcggaaggcaaaggaagaaggagcacttcacagggggagggagaacttcacatgggtggggcagaaagaagagagtcaggaggagatgctacacactgttaaacaaccagctctcatgagagctctatcctgataacagcactagggaaatgatgctaaaccattagaaaccacccccatcatccaatcacctcctatcaggcccaacctccaacattggggattacaactggacatgagattttggcagagacacaggtccaaaccatatccctcatcttcactgcagtggagcaacccacacccatagccatgccctccaccagaaggaaccacatgaaggtctgcccatcttcctgacctccatggacagtaggcgatgcccagtctccttttggtctgggggtttgtctcatatgctctccttggtacccacctgccagtgactcctctgtgtttcacacccctctcaggggatcccagatccacttgggtgctggtctctgtctggatgactagtaccagtttcccttagagaagggccaatgggaaatgcttatgtgaggaaggtaatgcttcgcttgactgctttgctcttaagtcctcaaaaaacaccacttacaagactgtagactctatgccgcttacagacttcaatgaaaagtcaatagtttctatatgaaatgatagtggaacaaaccactagtgagcaatggctaaatatcattgccccgggagtccaaaaagaaccacccatctcctgcctcccacagaaaaggtaagtttctctagggacacttcattttgggtgaatccctgttcatggcttttcttcctgttttgagcactgcccttttctcaccctgtaaaggggaaagtccccttcattaatctgcttcactgtagggatttctttatgtctcatcagtggaatctgtccacatctccacctctctatgaacatatgtacacatagggatactcacacaaaagctaaggaacgatgactgtcacacaataatccctaaccaattcactttgcaaaatctgaatttgtcagcgtaggttaacctccattactcagtctgagtctcagagtcttcaaagttcaattcctcatcctctggacatctctgtcctgccaatccatcattctcaatttggccatccctggggatacagattatcagcatgtctttaaccaatagcatgaagtgtggggctggcggggtgacttttttttttaattaaacaaagctagcctttctggttgatctcatctttacctctcactgtttgaaatgttttatttctaaagatgaccattgtttctctgcatcttcaatttcttctgctccactgatacttaacatcagcatactccaccatcctctatcttaaataccttcccttgttcacacttccctactacttattgttccatatatttgctgcccttcacagcaaaacttttctgatatcttgtctaaactggttgtcaccacttcctcatctccactgtcaatgtcttttatccccttcagacctttaaacctgcctttcttcatggtctttaacaaataaatgcaatagcaatccttagaggaaagtttatagtaataaatgcctacattaaaaagtagaaaaatgacaaataaacaacttaactttacacgtgaaggaactagaataaaaagtaaaaacgaagtccaaagttagcaaaaggaaataataaaatataatatagactagagcagaaatatgccaaataaataacaagtcaaatagagaaatggtaaacaaaatcaccaaaattaggagtttccttcttgaaaagattaacaaaattgataagcctacagctagacctactaagaaaaaagagagaagccactaataaataaaatcaggtttgaaagagaagatatttcaatggatgcctcagaaacaaagaatatcctaagggaagattatcaatgtatatacaccaacaaatcagataacctacaatggatacattcttagaaacataaaacctaccaaaactgaataaagcgaagtagaaatcctgaacagaccaaaactataagggtattgcattattaattaaaaatagcccagcaaataaaaccccagaagcagatggattcatgggtgacttctaacaaacattcaaagaaaaagtgctaacaatccttctcaaactcttccaaaaaatagaagatggaatactggcaaactcatcttataaagttagcatcaccctgatcactaaagataccaaaagaaaatacgactgctgacctatatccctgacaaacatagatgcagaaatcctcaatgaaatattagcaaattgaattcaacagcacgttaaatgtatcatacgtcataaccaagtgggatttatctctgggatacaagaatgattcttcgtgctcaaatcaatcagtgtgatacatcacattaacaaaatgaacataaatataccccacatgattaccttgatagatgcacaaaaagcatttggcaaatttcaacatcgattgattaatctgtccatgattaaaactctcaacaagatagatgtagaaggaacttacctcaacacaataaaggccatgtatgaaaatcccacagcaaactttataatcaatagggaaaacctaaaatctgtccctccaagttcaggtactaggcaaatatgcccactctcaccaattctattcaatagagtactggaagtcttggagttttagccagaacaacgagatacaaaaaagaaataaaatgcttccaaattggaaaggaaaaagtaaaattatctctgttttcagtatcatcataaaaacgttttgtttaaacaatgtttgtaaaacgatgatgttttgacatcatcataaacaaagaaaaccataaagactcaaccaaaagtaacgttagaattcataaaccaattcggtgtaattgcaggatataaaatcaacatacaaaaattagtcacatttccacacgcaaacagtgaactatccaaaaatgaagttaagaaaacaacccattcacaacagtaacaaaaataattaaataataaaatacttaggaataaagccaactgaagaagtttaagacctgtacactgaaaattacagaacattgatgaaataaattaaagaagacacagatgaatggaaagacatcttgtgttctatacatttccaatatgtatagaaactcctaaaagtcaatagcaaaacatgtattaaaaatttaaaaatggcaaaagacttgaatggacatttctctaaagaatacaaacaaatggccaacatgtatatgaaaagatgctcaatatcactaagcataaggaaaatgcaaatcaaaactagaaggagatatcacctcgtgcctgttagaatagttgtaacaacagaaaacactaagggcaatatgtattgacaatattgccgagaaattgaaacccttttaaaatatggtaggtatacaacgtgatgcagtcattatcaaaaacattacagggttccacgaaaaaattgccatatgatccagcaatcccacttctagatatattaaaaagacgaatacaggatctcaaagggatatctgcactctatgtttgcttcagcattatttacaataatcaagtgatggaaaaaacccaaatgtcaattgacagatgaatggatcaagaaaatatggtgacacacaatgggatattattcagactttaagaaggaagacttcctgtggaggaggtagagcaagatggcagaatagaaggctcctccgatcgaccccccatccctactccgcaaggacatcaatttatctacacacaaaaatatgttcatgagaaccaaaaatcacagtacctggttttcactttgtatcactgaaagatgcacttaagatgtaaaagggactgtcttgaattgctgacatgacccatcccacacctcccaacagcagtggtgtggtgtggagagcacttttgcacgctggtggaaggagagcacagcaactgcaaggcattgaactgaatgctgtcctgttagagcagaaaggaaaacacagccatcaactcagctgatgcctacccacaaagggagcatttaaaccagcctagccagaggggaattgccaatgccagcagtcagaacttgagttcccacaaacctcgccactgaggagtaacatgctctgggtctctaagtaaacttggaaggcagtctaggccacaagaactgcaactcttaggcaagtcctagtgctgaactggacccagagacagtggactgggagggcacgtgacctactgagacaccagctggtgtggctaagggagtgctggcatcaccctccctgaaccccaggttgcacagcttgcagctccaaaagagaccccttccttccacttgaggagaggagagggaagactggggaggactttgtcttacatgttggataccagctcagccacagcaggatagggcaccagtcagagccataaggcccccattcttggcactagctcccatacatgtctagacactccctgggccagaagggaacccactgtcttgaagggaaggatccagtcctggcatcttttatcacctgctaactgaagtgtgcttgggcccttaaaaaccagaagtgatacccaggtactacgttgagggccttgggagagtctctgagactttctggattcaggagagacttagcacattcttagctgtggtggctagagagcaaaactccttctgcctgtgaaaagcagagggaaaagtaaaagggactttgtcttgcaccttaggtaccagcttggccacaggggagttgaggaccaagcaagctcttggagttcctgattctaggacttgactcttggatggcatttctggacctgccctggggcaaatgggagcccattgccctgaaaggtgagttccaggccaggcagcattcaccacaagctgacttaggagcccctgggccttacaggaacatcagtgatagtctggcagcactccctgtggcctgtggtggtattggctatagggtgaggctcctctgcatttggaaagaggagggaagagtgagaagggatgcatcttgtggtctgattgccagctcagccacagtacaatagaacaccaggtagatttctaaggatttttactctaacccctaattcccggacggtatctctggacccacttggggcctgggggacctcactgccttgaagggaaggacagaggtctggctggctttgccccctgctgattgtggaatcccagggctttgagtgaacataggcagtagccagggagtggttacatcaggccttgttcaaaacccagtgttgttcaggcatcaggtctgacccagtgcagtcccagtggtggtggccacagggcatcttgtgtcactctaccaccagctttaggtggcttggaacacagagagagactccatttgtttgggagaaaataagggaagaaaataagagtctctgcctggtatttcagagaattctcccgaaatctgtcctagaccatcagggtggtacctctgcacatctgcaagaatgatagcattatgggcttggggtgccccctaaagcaaatacagcttaaatcacaacaccaactccttttgaatagctggaaagccttactaaggaggacaggtacaaacaagcccagacaatgaagactacaataaataccaatgcacagacactgacaaacatctacaaacatcaacatcatctgggaaaacattacctcaccaagtgaactaaataaggcaccagagaccaatcctggagaaacagagatatgtgacctttcagacagataattcagtatagctgttttgaggaagctcaaagaaattcaagagtaacactgagaaggaattcagaattttattagataaacttaacaaagatattgaaataattaagatgaattgagcagaaattctggagttgaaaaatgcaattggcatactgaagaatagatcagcatcttttaataccagaattgatcaagcagaacaaagaattagtgagcttgaagacaagctatttgaaaatacacagaagagacaaaaggaaaaagaaaaacaaacaatgaagcacacctaaaagatctagaaaatagcctcatgaaagcaaagctaagagttattagccttaaaaagaaggtagagaaagagataggggtagaaagtttattcaaagggaacataacagagaacttcccaaacctagaggaagatatcaatatgcaagtactagaaaattataggacaccaagcagatttaacccaaagaagactagctcaagacatttaataatcaaactcccaaagatcaaggataaagaaaggattctaaaagcagcaagagacaagaaacaaataacatataatagaattccaatacatctggtagctggcttttcagtagaaactttacaggccaggagagagtcacatggcatatttaaagtgctgaaggaaagaaacgcttaccctagaatagtatatctggcaaaaaaaaaaaaaaaatccttcaaacatgaaagaaaaataaagacattaccagacaaacaaaagctgagagatttcatgaacaccagacctgtcccacaagaaatgctaaaagaggtacttcaactggaaggaaaggacaataatgagcatcaagtaatcacctaaagatacaaaactcacaggtaatagtaaatacacagaaaaacacagaatattacaacactgtaactgcagtgtgtaaactactctttccctaagtagaaaggctaaatgatgagccaatcaaaaataataattacaatgtttttcacgacatgaacagtacaataagatataagagaaaaaagaaaaaattaataagtagggggacaaagttaaggtatagcatttttattagctttctttttgcatgtttgcttatttatgcaaacagtgttgttatcagcttaaaacaattggttataagatagaaattgcaagcctcatggtaacctcaaaccaaaaacatacacaagggacacacacaaaaaaatcaagaaaccgacatatatcaccagtgaaaatcaccctcacttgaggaagacaggaaggaaagaaagaaggaagaaaagaccacaaaacaccagaaaacaaataacaaaagggcaggaataagttattacttatcagtaatatttgtattacttcattctcatgttgctttaaagaactgtctgagactgggtaatttataaagaaaagaagtttaattgactcacagttccacagggctggggaggcctcaggaaacttgtgaccatagcagaaggggaagcaaacacatccttttacacatggcagcaggaaggagaagttttgggagcaagccccccaaaatctggccataaactggccccaaaactggccataaacagaatctctgcagtactgtgacatgttcataatggccctaatgcccaagctggaaggttgtgggtttacgggaatgagggcaaggaagaactggcccacccagggtggaaaacagcttaaaggcattcttaagccacaaacaatagcatgagcgatctgtgccttaaggacatgctcctgctgcagttaactatcccaacctattcctttaattcggcccatcccttcgtttcccataagggatacttttagttattttaacatctatggaaacaatgctaatgactggtttgctgttaataaatacgtgggtaaatctctgttcggggctctcagctctgaaggctgtgagaaccctgatttcacacttcacacctctatatttctgtgtgtgtgtctttaattcctctagtgctgctgggttagggtctctctgaccaaaatcatcagatcttgtgagaactcactcactatcacgagaacagcatgtggtaaccgcccccaagattcaattacgtcccaccaggtccctcccatgacgtggggattatgggaactataatacaattcaaggtgaaatttgggtgtggacacatccaagccatatcaatattgaatgaaaatggactaaactctccaatcacaagacatagactagctgaatggataaaaaacaatacccatcagtctgttgcctacaagaaacacacttcacctataaagacacacaaagactgaaaataaaaggatggaaaaaggtagtccatagcaatggaaaccaaaaagcagcaggagtcactgtacttacatcagacaaaatagatgtcaagaccaaaaccataagaaaagaaacaggtcactgtataatgctgaagggttcaacttagcaagaggatataacaattttaagtatatatgcacccaacactggagcacccaaatatataaagcaaatattattagagtgaaagagacaggccccaatacaatgatagctggaaacttcaacaccccattttcagcactggacagatcttccagtcagagaaccaagaaagaaacatcagatttaatctttattgtaaatcaaatggctctaatagtttgcaagagcaaatcaaaccccaacattagtagaagaaaaggaataataaatatcagagcagaaataatgttgaagaaagaaggcagaagattaatgaactaaaaaagttacttttttgaaaacttaaacaaaattgaccaacctctagccagactaagagagaagatccaaataaataaaatcagacatgaaaaaagagacattaaagctgatactgcagaaattcaaaggattattagtgactaatatgagcaactaaatgccaataaactggaaaatctagaagaaatgggcaaattcctagacacatacacccaccaacattgaacctgaaagaaacccaaaacctgaacagaccaataacaagtaacaaaattgaggccataataaagtctgccagtaaagaaaagcccaggacccaatggcttccctgctgaattctaccaaatatttaaagatgagctaatactaatcctactcaatactactccgaaaaatagaggaagagagactacttccaaactcattctacgaggccagtattaccctgataccacaaccaggcatcaaaaaaagaaagctacaggccaatatctcttaggaatattaatgcaaaaatcctcaacaaaatactagctaactgaattcaataatacattagaaagatcagtcatcacgaccaactgggatttctccctggaatgcaaggatgattcaacatatgccaatcaatcaatatgatacatcctatcaacagaatgaaggataaaaatgatataaccatttcaatggatcatttctatataaagcatttgataatatccaacatcccttcatgataaaaaccctcaaaaactggggatagaaggaatatacctcggcaaacgtgaagatggctgaataggaacagctccagtctacagctcccagcgtaagcgacgcagaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaagggtcagggagttccctttccgagtcaaagaaaggggtgatggacccacctggaaaatcgggtcactcccacccgaatattgcgcttttcagaccggcttaaaaaacggcgcaccatgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcacagcacagacaaacaaaaagacagcagtaccctctgcagacttaaatgtccctgtctgacagctttgaagagagcagtggttctcccagcatgcagctggagatctgagaactggcagacggcctcctcaagtgggtccctgacccctgacccctgagcagcctaactgggaggcaccccccagcaggggcacactgacgcctcatacagcagggtattccaacagacctgcagctgagggtcctgtctgtttgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctgctcctccaaaggaacgcagttcctcaccagcaacggaacaaagcaggatggagaatgactttgatgagctgagagaagaaggcttcagacgaacaaattactctgagctacgggaggacattcaaaccaaagcaaagaagttgaaaactttgaaaaaaatttagaagaatgtataactagaataaccaatacagagaagtgcttaaaggagctgatggagctgaaaaccaaggcccgagaactacgtgaagaatgcagaaccctcaggagccgatgcgatcaactggaagaaagggtatcagcaatggaagatgaaaggaatgaaatgaagtgagaagggaagtttagagaaaagagaataaaaagaaatgaacaaagcctccaagaaatatgggactatgtgaaaagacaaaatctacatctgattggtgttcctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcaggaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacacactttaaaccaacaaagatcaaaagagacaaagaaggccattacataatggtaaagggatcaattcaacaagaagagctaactatcctaaatatatatgcacccaaaacaggagcacccagattcataaagcaagtcctgagtgacctacaaagagacttagactcccacacattaataatgggagactttaacaccccactgtcaacattagacagatcaacgagacagaaagtcagcaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccactcagctacatggacactgaacaacctgctcctgaatgactactgggtacataacgaaatgaaggcagaaataaagatgttctttgaaaccaaagagaacaaagacacaacataccagaatctctgggaggcattcaaagcagtgtgtagagggaaatttatagcagtaaatgcccacaacagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatctacaaaattcatagacagctagcaaggctaataaagaaaaaaagagagaagaatcaaatagacacaataaaaaatgataaagaggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattgtaccagaggtacaaggaggaactggtaccattccttctgaaactattccaatcaatagaaaaagagggaatcctccctaactcattttatgaggccagcatcattctgataccaaagccgggcagagacataaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcagtaaatgtaatccagcctataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaactaggaaaagaggaagtcaaattgttcctgtttgcagacgacatgattgtatatctagaaaaccccattgtctcagcccaaaatctccttaagctgataagcaaattcagcaaagtctcaggatacaaaatcaatgtacaaaaatcacaagcattcttatacaccaacaacagacaaacagacagccaaatcatgagggaactcccattcacaattgcttcaaagagaataaaatacctaggaatccaacttacaagggatgtgaaggacctcttcaaggagaactacaaaccactgctcaaggaaataaaagaggatacaaacaaatgtaagaacattccatgctcatgggtaggaagaatcactatcgtgaaaatggccatactgcccaaggtaatttatagatccaatgccatccccatcaagctaccaatggctttcttcacagaattggaaaaaactactttcaagttcatatggaacaaaaaagaggccgcattgccaagtcaatcctaagccaaaagaacaaagctggaggcatcacactacctgacttcaaactatactacaaggctacagtaaccaaaacagcatggtactggtatcaaaacagagatatagatcaatggaacagaacagagccctcagaaataatgccacatacctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagatttaaacgttagacctaaaaccataaaaaccctagaagaaaacctaggcattgccattcaggacataggcatgggcaaggccttcatgtccaaaacaccaaaagcaatggcaacaaaagacaaaattgacaaatgggatctaattaaactaaagagcttcttcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaactccatcaaaaagtgggcgaaggacatgaacagacacttctcaaaagaagacatttatgcagccaaaaaacacatgaaaaaatgctgatcatcactagccatcagagaaatgcaaatcaaaaccacaatgagataccatctcacaccagttagaatggcaatcattacaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagtactataaatcatgctgctataaagacacatgcacacgtatgtttattgtggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaagtatcgcaagaacaaaaaaccaaacaccgcatattctcactcataggtgggaattgaacgatgagatcacatggacacaggaaggggaatatcacactctgggactgttgtggggtgggggaaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaagaaggaatatacctcaacataattaaagtcatttatgacagacccacaactagcatcacactgaatggggaaaaactgaaatcatttcttctaagatctgaaacacaacaaggaagcccactttcactgctgctattcagcatggtactagatgtcctagctagagcaatcagacaagagaaagacataatggacatccaagttggaaagcaagaagtttaattattcttgtttgcagaaaatatgatcttataaatgaaaaaatctaaagactccgtgagaaaactatttgagctaataaacaaactcagtaaagttgcaggatacaaaatcgacatatgaaaatcagtagcatttgtatatgccaacagtgagcaatctgaaaaagaaataaaaaagtaatcccatttacaatagccacacataaaattaaatacccaggaattaaccgaagaagtgaaagatctctataaagaaaactataaaacactgatgaaataaattgaagaggacacgaaaaaatggaaaaatattccatgttcacagattggaagaatcaacactgttaaaatcttcataccacccaaagcaatttacagattcaatgcaatccctatcaaaataccaatgacattcttcacagaaatagaaaaaacaattctaaaatttatatgaaaccaaaaaagaccaagaatagccagcactatttggctaacaaataaaaataaaacattatgaacttaaagtttatactactgagatataataaccaaaacagcatggtactggcatcaaaagagacacagagaccaatagaacagaatagagaacccataaacaaatccacacacctacactgaactcattttcgacaaaggtgccaagtacctacagtaggaaaaagacagtctgttctataaatgttgctgagaaaactggatatccatatgcagaagaatgaaactaggcccctatctgtcaccatatagaaaaatcaaatcaaaatgtattaatgacttaaatctaagacctcaaactatgggactactgcacaaaaacattggggaaaatttccaggacatcagactgggcaaagatttcttgagcaataccccacaagcacaggcaaccaaagcaaaaatggacaaatgagatcacatcaagttaaaaggcttcttctgcacatcaaaggaaacaatcaagaaagtgaaaagacaacccatagaatgggagaaaatatttgcaaactacccatctgacaagggattaataaccagaatatagaaggaggtcaaacaactctataaaacatctaatgatccgatcaaaaaatggacaaaagatttgaatagacatttctcaaaagaagacatacaaatgacaaaaagtcatatgaaaaggtgctcaacatcactgatcatcatagaaatgcaaaacaaaactacaatgagatatcatctcaccccagtttaaatggcttctatccaaaagacaggcaataacaaatgctggcgaggatgtggagtaaagggaactcttgtacactgttggtgggagtatacattggtacggccactatggagaacagtttggaggttcctcagaaaactaaaacttgagctaccatatgatccagcaatttcagtgctggatatatacccccaaagaaagaaaatcagtatattggagagatatctgcactcacatatttgttgtggcactattcacaatagctaagatttggaagcaacctaagtgtccatcaagagatgaatggataaaaaacatggtacatatacacaatggagtactattcagccataaaaagaatgagatcctgtcatttgcaacaacatggatggaactggagatgattatattaagtgaaataagctaagcacagaaagacaaacactgcatgttctcacttgtttgtaggatctaaaaatccaaacagttgaactcatggacacagagaatagaagcctggtaccagaggctgggaagggtagtgggggctggtgagaaggtaaggatcattattgggtacaaaaaaataaaaagaatttataacacctactatttgatagtacaacagggtggctgtagtcaataataatttaattgtacatttaaaaataactaaaagagtgtaactggtttcttttattataacacaaaggataaatgcttgaggggatgcatatcccattctctatgatgtgatcattgtacagcacactcctgtaccaaaacatctcatgtatgcccacaaaaattaaaaataaaaaaaattaaaataaaaaaggaaattctatctttcatgacaacatcgatggacctagaagatactagctaagtgaaataaatcagttgcagaaggacaaatactgcatactttctcttctatgaggcatcaaaaatagtcaaacatgtagaagtagaaaatagagtggtggttaccaggagatggggatatgggatattaggagctcttttttcagtggttataaagttacatttatacaagatgagtgcgttccagagatttcctgcacaacatagtgtctgtagttaacaatgaggtattgtgcacttaaacatttgttaaaagggtatatgtcatgttaacttttcttataaaaagaaaagttaaaaaacaacattaaaaaacaacaacaaaggaacacaaggaaacttttgcaggttacggatatgtttattactctgattgtagtatggcgacatgagtgtatacatatgtccaaactcatcaaattgtacacattaattaggtacagtttttatataccagttgtacctcagtaaatctagaagcaggaagaaaccttgtgtcacttcatcaaaaatacataaccatccaaatatgttatcagctaattccagagattcaaaatatatgaagaaaatattgacaataataaaataataaatagacaaatatacaaatataactgaagactttcaacatctttctgccaaaaatttacacaagtagacaaaagaaaaccagaaagaacattttaaaaactaaacactaccaaccaactcgacctaattgatgtttataatacattctttgtgagtccataagaaacatctaccaagattgactgtgttctaggctctaaggcatgtctcagtaaatatcagaggactgaaattcagattatattttctgatcagatcattattaaatgagttatctataataataatatatcaagaaatatctatttggaaattaaacaatccacttttaaataactaatctattcaggaataaatcataaggaatttataaaatattttctactgaattgtcatcaatttttttaggcagatctcaaatcaatcatcttatgccttaagactcaagaaaaggagtagaaaattaaacccaaagtaaataaaagaataaataattaaagtggtagatgtcataatgagaaaatataaaaaataaaaaaacaaattcaaaaggccatttaaaaaatattagtaaagtttatataaccctagccagagtgattaagaaccaaaatgactcaaaataccaacataaggaatgtaaaagtggaaattactgtagactctagtgaaattaaaggaaagtaaaaatatataaaaactggataacaaaaatttggaaaacttggataaaatgaacaaaatttcttgaaaaatataatttaacaaacttacacatgaaaatatagaacatgtaagtggtcccacatagaacttagtcaaaagccttctatcctagttagcttcaccagtgtattctcttgataatcaagcaggaaaacaatgccaattctacagaatttctttcagaaaattgaatagaattaaaaacttcccaactcattctatgagaccagcatcaactagataaaatgttaagtttcttaagtatttccaaatcaagcaatgtaatatatctcattaacagaataaaggaatgatagtgtaactatctcagtagattaagagaaaacttttgacacaatttaagacacacacgtgatttcttaaaaccaatttctagatgttaggagctactatttgtatctttcttaaagaaagtcttagttttaataatcttttggggtaaataattttaagtttacataaaagttccaaagatagtacaaagaattcttgtatagcctctaccaagtttcctttaatgttaacatacaatgatacttttgtcagaactaagaaatcaacattcgtacaataccaatagctatagacgttatcagatttcactaattttctaatgtaggggcagaaaaggtgtgatacctttcttcaaccatcataacagtcatgaccaacattcttataacaaagacagattaacaaaagaaatgtacaacaagtttatttaatcaaagttttacacgacatgggagaattcagaaatgaaggctcaaagacccagggaaaactgcccatgtttatgcttagattctacgaataatggacagccatatggaaacgtgattggacaaaaaggtatgacctaataataataggccaagagggggaacctggcaaggcctgtccagattcttcttggcctctctgtttagcattccttcatccatggtatggagcaagacccttctggaatggaggtcttatgacctactgtcagacaagttagttcagagaatttctttatggcccgttcttacacagaaaggagggagtaggttagagtagtatttctaggttttatggctggctttgggggagaggagttgtagtttctataactatccttggggaagaagaattttgtttctatgacttgtttgaggggagaaagaagggtgagagacaggagggcaggagaaggtcggagagactttgcttctgcagctacttctgaggtcttctggtctcctttagttcaaagtactcatcatacaaaaacaccatactttggggtattattttctgagccctaacaccactaatacccttttactgataatatgcagtatatcacattacattttgttattgtgtctctgtattctcctctactcagtgatagtttttattgtttctctttttttatggccttgatacaattgaagcattctgttaaggtaatttgcagcatgttcctcaatttgaatataactgatgttttctcatgattaaatggggttataagtttgggagaagaatatcagaaaaggtgaagtttcctcctttgcatctttctctccagaagctggagcttaatttcttccctagagtgtgggctgaattttgtgacttgcttcctaacagtagattatggaaaaggtaaatagcaactttacagtgaagaaacatggcagacaacaccttaaacaagtgatcaatagtaacatcatgcttgatgtaacgcaatgagaagtgaacctctcctttcatgaccagtgttaacacatgccctcaatctgagggacctgaatctaactccaggtggataatgtcagaattgaattaaatcataggacacatgattagtgtccactgaagaactgtttggtgtaggggtaagcccctacacatctggccacagaagtgatctgtcttgggagtataataggagaaaaaacaattagcttgtttagtttttttttcctactttacaaaatgtattttgtgtgatctctattatcttaagtttgttaagacttatggcccggaatgtgatgtctcttgatgaagaatatatattgtcctgatgttgagtagagtgctctataaaatgttcaattggtcaagtaggttagaagtgtcattcaggtaatctatatctttataaattttctgcctacttgttctattgattacagagaaatgagttttaaactccccaactattactctgaaattgtctgtttctcctttcagatctatccatttttgtctcatgtattttaaataaagctctgttgttaggcacatacatttttaggattgttatgtcttcttggagaagcgacatcattatcactatgcaatgttcctctttatctgttataatcttatgtgacctgaagtctacttatccaaaatcaatatagctattccagtttccttttagtgttagcattgtatacctttcttgatccctttacttttaacctaagtctttatatttaaagtggctctctgtagacaacaaatagctgggtcttggcttttaattcaatctgataatctctatcttgtttttatttgtaaaaatttaagaggtacaagtgcaattttgttacatggatatagtgtatagcaatgaagtctgggctttcagtgtaaccatcacctgaacagtgtacattgtacccattaagtaatttctcatttctcatccctcatccccctcccaccttcccatccttcaagtctccaatgattattatttcacactatttgtccatttgtacatgttatttaactcccacttatgagtgagaacatgtagtatttgactttctgtttccgaattgtttcacttaagattagggcctccagttccattcacattgctgctgaaaacatgattttattcttttttattgcagaatagtattccattatgtgtgtgtatatatatatatatgtatatgtatatatcacagttttatatatgcatatatttgtgagatatatatgtatatatgtatgtatatatatcacattttctttacccaatcatccattgattgacacgtaggttgattccatatctttgctattgtaaataatgttgtgataaacacatgagtgtaggtatctttttgaaataatggtttcgttttctttgggtagatactcagtagtgggattttgctggatcaaatgatagttctatttttagttttttgaggaatctccatgttgttttccataaaggctgtactaatttacattcccacaaacagtgtataagtgttcccttatttcccatcctcaccaacatctgtggggtttttttgtctttttaataatagctattctaagtagtgtaaggtgatacctcattatgattttaatttgcatttctctgatgattagtgatgttgagcattttttcataagcttattggccatttttatgttttcttttaaaaatgtgtgttcatatcctttgtccactttttaatggagttatttgggggtttatgttaagttgagttccttgtaaattctggatatctgtcccctgtcagattcatagtttgcagttttctcccattctgcaaattgtctgttcactttgtggattatttcttttttttttttccttttttttttttttttttgctttcttgattttatttcaaaagtacacaaggtcacaaaactagagcaagttgtttttcttaacaaattttgttcttacaaatttcaaaatctgcaccattggatatataagccaaaaatcatatatacaaaatctgaaactgacactgtcaattctatactttgcacacgtgaagtgtcaaaatatttttctcagtagtacaagtgtatttatcactaaaattcacaattagggaaaagaataagtgaatcaatgaactgtggttctcttaaaacttgtgtcattaaatatgttagcagaaaacacaaagttctgttttgttggaacttttagtctcgatgactaaaaccaaacccaacggatatgtactatattcttaaattataaaataagataaattataatagttaaccttaatgaataagaggctagttgttgcgggaagtcagggaccccaaacggagggaccagctgaagccatggcagaagaatatggattgtgaagatttcatggacatttattaattccccaaattaatacttttataatttcttatgcctgtctttactgcaatctctaaacaaattgtgaagatttcatggacacttatcacttccccaatcaatacccttgtgatttcctatgcctgtctttactttaatctcttaatcctgtcatctggtaagccgaggaggatgtatgtcgcctcaggaccctgtgataattgcgttaactgcacaaattgtagagcatgtgtgtttaaacaatatgaaatctgggcaccttgaaaaaagaacaggataacagcaatgtttaggaaacaagagagataaccttaaactctgaccgccggtgagccgggcggaacagagccatatttctcttctttcaaaagcaaatgggagaaatatcgctgaattctttttctcagcaaggaacatccctgggaaagagaatacatgcctgggggtgggtctatagatggcccccttgggtgtggccgtcttctatggtcgaaactgtaggggtgaaataaaccccagtctcccatagtgctcccaggcttattaggaagaggaaattcccgcctaataaattttggtcagaccagttgctctcaaaacgctgtctcctgataagatgttatcaatgacaatggtgcccgaaacctcattagcaattttaatttcgccccagtcctgtggtcctgtgatcttgccctgcctccatttgccttgtgatattctgttaccttgtgaagtacctgatctttgtgacccacaccctattcgtacactccctccccttttgaaagtccctaataaaaacttgctggttttgcagcttgtggggcatcacggaacctactgacatgtgatatctcccctggacgcccagctttaaaatttctctcttctgtactctgtccctttatttctcaaaccggctgatgcttagggaaaatagaaaagaacctacgtgactatcggggcaggttccccgatagctggtattatctgctataagataaatgatcagccttccctaaagataaactgaaccacaattcacaaatttgtttattattcttccctgcttctataacatttacaaaaataatttgtcctcagttatggcctattttagtgttaaaataggtaaatgagtaagaaatcctattgcagaacataatgcctttattgctggaatatccaaaggcattcaaaatattaaaacttgcccagaacatttacactactaaacacaggaatgttataaagatatatgtacatatatatataatatataatgtcacaagccactaagaagttaaaattctgccaacattttatacaaactactctttatgtgacacatcaaagcattaaccatgtaaaatatgaactttttctgttcccacttgaataaggcatctgaaagccctaaacactgctgaagtgaaaattagaagaaaaaacacttaacattcacataacaccaaatgtacatgctgcacgcacacaaaagacacttagaatatttttaagattatttcttttgctatgtagaagctctttagtttaattaagtcccattgtctacttttggttttgttgcttgtgcttttaaggtcttaatctccatcttttaattggtatatttagatcattcacatttgcagtggtattgatacagttggattaaaatatataacctttctagatctttactatttgtttcatttgttttttgtttcttttttccttttatgtctaccttctctgggtttaattgatgtgtttatgacttttctatatgctttattgaattattatttatacctctattttgctttttacatgattgttcttacatttgcaatgaacatttttaaataacctaagtccaatttcaaatactattatatgaatttttgtgtagtgtaagaaccttataacagtacattcctattgtcccctctcataccttgtggcattacgtttcatttttacataagctatcaacacatagtattttgttactattgttttaaataatctgtcctattttctagtaaatagaaggaagattatattttatcctcatgtattattccgttttcaatgttctagatttctttgtgtagatccaagtttctggccttatcattttccttttgcctgaagaatttattttaacatttctacaaatggtctgctaacaataaattatctcaacttacatttatctgagaaagcctttatttctcttttacttttgaagaatagtttcacgagagatagaattctgggttgaaagggttttttttttctttcagcactttaaatatgtaacttcattgtcttctggcttgcatgatttctgatgagaagtctgctgtaattattattatagtttctctatagataatgtgccccttcccatccattggctaccttcgagaatgtctttctttggttctcaaaaacttgaatatgacttgactgtatgtggttttattttgctatctatcctgtttgatgttttctgagcttcttggacccatgtggggaggggttatttgtcattaattttggaaaatttggggctatttttctgctcaaatttatcttatggccctttccttctctttctaagacttcaattatgcatatattaacctatttgatattgtctaatagatgttggaagctctattctgctttgttttcactctttattctgtttcagtttatgaaattttgcatgatactttttcaagttcagtgcttcttcccttggctatattaagtctactgatatacccactgaaggcattcttcatctttgctactatgtttcttatttctaccatttacatttgacctgttctcatcattttcatctctctgctaaaataatctgtctgaccttgcatgctgtctacatttctcattagagattttgatacatttaaatcacagttacttttaattctttgatagttagaacatgtgtttcatacctgagtctggttctaattattgctttgattcttcagaatgtgagatatttgtatacctcataatttttgttaaaagcaggacatgtgtataggacaggagatacaaacataaatattacattttatgcttggacatgagtatggctttcattttgctagaattttattatggggagtttgctaatatagtaaggagttgacctgggcatttgaagttccttgttgcaatggttactctacatgaaccagagatttaagattgatacattgagacactttctgggggaagcaggacaaagggaagatgcaaagaaaaggggagtagggagacaataacaagacaaaaaatttctcctcctgctccttcccaaggagtagcactgcttttcttttttctatgttcccctcctacagctaggttacagttttgatacctctttccctatagattaaatcttttgtactgtaaggaaaatagggaagacgagtcagctggaacttttggtaggggcttctctttctctctcccagcaagctctattggtgttcgttctaaggatcctctcagatctttttgtgggcatctagagaggttcttggagaaaaagctcaggagacaatgtgagacccctccagggacttcatactctcctagtagcccacattcagccttgtcttgaaatttcagacatttcttgaaattttctattttaatcttcttaatgtcttatgtcagtgtcagtggtcctcaacctttttggcaccagggaccagtttcgtggaagacaatacgttttttttttttttttgagatggagtctcgttccgtcaccgaggctggagtgcaatggcgtgatcttggctcactgcaacctctgcctcctgggttcaagagattctcctgcctcagcctcccgagtagctgggataatgggcgcgtgccaccatgcctgactaatttttgtatttttagtagagacgggtttccccatgttcgtcaggctggtctcaaactcctgaactcatgatctgcctgcctcggcctcacaaagtgctggcattacaagcgtgagccaccgcgcccggccggaagacaatttttcacggactgggcatggagtatggtttcgggatgattcaagtgcattacatttattgtacactttatttctattattattacattgtaatatataatgaaataattatacaactcaccataatgtaggatcagtgggaaccctaatcttgttctcctgcaactagacagtcccttctgggggtgatgggagatagtgacagagcatcaggaattagattctcataaggagcgtgcaaccaaatccctggcatgcacagttcacaatagggttcccattcctatgagaatctaatgccgccactgatctgacaggaagtggagctcaggcgtaatgcaagtgatggggagtggctgtaaacacagatgaagctttgctcactcactctccgcttacctcctgctgtgcgaccctgctcctaacagaccacggaccagtaccagtccgtggcccaggggttagggacccctggcttacatggcatttgggcagtgtctgtcccatgcaagcaaatgctcatgtcctctttccacctgcgagcacctgagtttcactaatttttgtgttaaatgtatttcatgagacctccgttctctgaagtgttcccaagaagtcattactttgcagtttttccacctctttttcttgttttatgagtaggaatgatgctcctgacatctatgggcatttctgagctcaaaccataagcactcagcaaaaatctttttaaaagatggtgctgatcagttgaatatcaatatgaaaagaaatttgatccttgatccctatcagacttcatatatggtccttcaccaaatagcaatatttcagtcaatgacagaccacatatataatggtggtcccataagattgtaatacagtatttttattgtaccttttatatgtttatatagttttatgtatacagatacttaccattgtgccacaatcagttataatattcagtatagtatcatactgtacaggtgtgtagcccaggaacaatatggctaggtatatagcaagctatatagtctaggtgtgtagtaggttataccatctagggtcatgtgagtacactctatgatatttgcacaattatgaatttgcctaacaatgcatttctcagaacatatccccatcattaaacaatacacgattgtacatccttatcttattactgtccactgtttgggcctcttgaagacaccaatctggcaagctactctacatgctcttaaaagttctactggctttttctcactccagtaaagttccttctcctattattgttctgataccttgtccaccattgcacagactcatcacataactctagcagctagtgatctttgttcaccaaacaaggacatgtcctattatggaatttagtttctttaaatttatttgtctacacagatctttcgtgtctttacaaatgagtacttttttgagttttcttttattttgtcagttttttgtcttagttgatacaattgtcacaatggtctgtcatgatattctacctctgaaatggaagtgacacatctattaatagttatttaaatggtatgttcaaagaaggtacattaaggactgcctgacacaagtcatttctaactaaaagccaccacaaattattcctgactagatgccttcatgtttattttttgaaaaaaaatcaaaataatactccataaaacctgttgtaaattttatattctatgtattactgacatatttggatatttgtacataatctttaactatatatttattaatgcctgtatactacaatgccatatggatgtaccataatttatttaaacactcccctgttggtggtcatttagatttttctcctggtgataagtatgtttgagcaatagctacacacaatataattggttaggtagttttttaaagcacagacatgttcttaattattcttgaagattatattttatgttagaagaattttaaaggactaaattaatgtagttagtagaaaaactcttagtcaataaaatatgaggagacagagatgagatttaaaaaaaaaaaagaagactattgccaggcgcgatggctcatgcctgtaatcccagcactctggggggccgaggcgagtggatcacctgaggtcaggagttcaagaccagcctggtcaacatggcgaaatcccgtatctacaaaaattagccgggtgtggtggcgcctgcctgtagtcccagctacttgggaacatgaggcaggagaatcacttgaacccgggaggcggagactgcagggagccaagatcacgccactgaactccaacctgggtaacagagcgaaactccgtctcaaagaaaagaaaaagaagactacaaatattctcaaggctaaggaccacaaaatgtaactgaactaaggatatagctggaatctgagagagtgggggacacgtttcatgtaaaactgaagggacgaatctacttcaggtttttccatttatgagaaccacctcctcacctctccccacccacccccaaggacacatttgctgttgaaattatatgaggcaaatccagccacaagttaaataagtagaaatgaagagcagagatacagggcttttatgaattttaactagggggagaatttgggagatgtttgactagagaataaaggaataaagtgtgacattctatggagaagggcttgaagctaaacacaagatgtattttgaacctgcaaacttgagaaattcttgatctttgtatctgcctgtcatctccccagctgcaatgagtaggatcaaggtaaaataaccaagtctttttttttttttttttttttttttgagacggagtctcgctctgtcacccagcctggagtgcagtggcgcgatctcggctcaccgcaagctccgcctcccgggttcatgccattctcttgcctcagcctcccgagtagctgggactacaggcgcccaccacctcgcctggctaatttttggtttttttttttttttttttagtagagacgggggtttcaccgtgttagccaggatggtctcaatctcctgacctcgtgatccgcccacctcggcctcccaaagtgctgggattacaggcgtgagccaccgcgtctggcaaccaagtctttcttaagtccaaactgcatatttctattatatttagaagagaataacaggagagcggagagaagagggaaagcctgggtgcaggtatatctgggagtgggtggtggcttatttgttttgatgggagttgtcagctgttctcagaccactatcttgacttatcttcttgcctcttgctgctgccaaagatcaccaatttactcagagttagttgaatgggaatacctcggaagtcttagacaaacaatttataatatcttatttcaaatactgttgtaatgggcatactgtacataaaattcttattaggccagggaggctgaggtgggaggatcacttaagaccaggagtttaataccagccttatcaacatagtgagaccccgtctctacaataaataaatagccaggcaaggtggcacacacctgtagtcctagctactcgggaggctgatgtgggagtatcgcttgagccctgaaaattaaggctgtcatgagctatgatcatgcaactatactccagcccaggtgacaaagtgagaccctgtctctaaaaataaataaataaataaataaataaatacatacatataaatataaattctcattaatctctgattttttccttaggattaatctccagaagttgtgctaccaggttattttctcctatattgccaaatttcactgtaggttcttcttttaatgaccaactcccagaagtttctacatgatttattttccctaaatagggcgtaaatcatgagaacattacaaaagaggacagaaacaagcagtggagaaaggattccctatttaataaatggtgctgggaaaactggctagctaaatcaggaaactgaaactggaccccttccttacaccttatacaaaaattaactcaagatggattacagacttaaatgtaagacctaaaaccataaaaactctagaagaaaacctaggcaataccattcaggacataggcatgggcaaggacttcatgactaaaacaccaaaagcaatggcaacaaaagccaaaatagacaaatgggatctaattaaactaaagagcttctgcacagtaaaaaaaaacaaatcatcagagtgaacaggcaacctacagaatgggagaaaaactttgcaatctatccatctgacaaagggctaatatccagaatttacaaagaacttaaacaaattcacaagaaaaaaacaaccccatcaaaaagtgggggaaggatacgaacagacacttctcaaaagaagacatttatgcagccaacaaacagaagaaaaaaagctcatcatcactggtcattagataaatgcaaatcaaaaccacgatgagataccatctcacgccagttagaatggcgatcattaaaaaatcaggaaagaacagatactggagaggatgtggagaaataggaatgcttttacactgtgggtgggagtgtaaattagttcaaccattgtggaagacagtgtggcgattcctcaaggatcgagaaccagaaataccatttgacccagcaatttcattatgggaaccacctgggtatacacccaaaggattataaatcattctgccataaagacacatgcacatgtatgtttattgcggcactgttcacaatagcaaagacttggaaccgacccaaacgcccatcaatgatagactggataaagaaaatgtggcacatatacaccatggaatactatgcagccataaaaacggatgagttcatgtcctttgcagggacacggatgaagctggacaccatcattctcagcaaactaacacaagatcagaaatccaaacaccacatgttctcactcataagtgggagttgaacaatgagaacacatggacacagggagggcaacatcacacaccagggcctgtcggggggtagggggctaggggagggatagcattaggagaaatacctaatgcagaggacgggttgatgggtgccgcaaaccaccatgggacttgtatacctatgtaacaaacctgcacgttctgcacatgtaccccagaacttaaagtataataataataaaaaaaaagaatactaaagctgaaaggttcacattaccagatagcaaggcttatttaaaaactgtagtaattaagagactgtattatgggtaaaagaataaaaactagaccaaacgaacaggctagacagcccagaaacacacatacacatatatggtcacttgatttatgacacagtaccataacactgcagtggcaaaaagtatttctaattgtgctttgtcaattggatattgctatggaaaaaaagcaaatcttaactccttctgcataacatacaaaataatcagttctagaagtattttagatctaaatgtgagaggtaaagtaataaatattttagaggaaaacatagaagaaaatgaccataaacttgcagtatcaaatgtgtcttttaaaatttctgtattccttttatttattcatttttaaatcttcgacacaatttaacctccagaaaagttacgagaacaacactaaaaggcctatatacatcttaatattatattatgtcatttcctaaattctcctctctctttaattctctatatatctctatatattttttctgaagcctttgagagtaagttgcaggcatgatgtccttttatctctaaatattttattgcatattttcttaaaaactaggaaattctcttttctaatcacagttcaattagaaaaatcagacaactaatattgatgtaataatatctaataatagaacttatattttataacttcaaatgaatccatttttatggcctctggattttcgatgttagttggaaatcctttcactatacacacgttaaagaggaatttatacacattcttctggtatttatatgatcattttttatctatttggcaaaaccagtcatctaagcaaaatttattaaacagttgatcttttagccatttgaaatgccagcttcatctcatactgaaattctacatgtacttttatttaatggatagtcttaaagggctagtccccctccccccttgcagctttttcttttttcctttttaaaagactgggatctcattatatggtccaggctggacttgaactcctgggctcaagcaatctttctgcctcggcttcccaagtaggtaggattacaggtacatgccaccatgcccagctgtagctttttcttttagcgtgtattattgtatattatgtttatttttccatatggagttttataccaaaatgtctggatccatcaaaatggtgattgacatttttaattgagattgagtgaaatttacaaattaacttacagaaaaattataattttatgatgctgaataattctatccaagaaaatgtgaagtctttccatttattcaagtttacttgtgtctttcacaagtattgaaattttaattaattattatttttttgtgacggagtctcactctgtcacccaggctggggtgccatggcacaatctgggctcactgcaacctctacctcccaggttcaagcgattctccagggtagtagagatggggtttcaccatgttagctaggctggtctccagctgctgacctctagtgatccaccggcctcagcctcccaaagtgctgggattacaggcgtgagccactgtgcctggcctctcaataaatttaagtatcttatcatgttttttctatttcaaacggatttaccctacaggattataatctctaattaatttgtttctataaaaactattgagatctatatggtaattttctatcctatttattgaattgaattgttttcttgtttgagtagcctttatcattgattctcttaggttttccagataaacaatcatatttgctaatagaagtagtttcaattctttctgagatcttacagctctaattgatgtttctaattgcattagttaatacctccaggaaaatgatgaatagatgtgaaacaaattatatccttatctgtgtcctgatctcttaatgtcttaatgtgaaatgatctcttaatgtcttaatgtgaaatgcatttagtgtttcatcattaagaaagacgatgagttttagtatgaagggtgtgtgggtacgtgtaatatacaatattaataagtgatgtctacctgtattattctttttgatactgtcttgcccagtttaagtatcaatgctttagttgctttcataaaaacaactatgacatttcccataattttcaacgctttggaatagttaatgaagcattgggactatctagtttttgaatatagggagaattcccctttaaaaccgtcttggcttggagattttaatgggatagttataaatttatattttattctttctatgaaacttagtctgtttaaattttccatctctaatggagtcaatgttgacacacagtattttcctaaacaattatacatttcatttgggtttcaattttatatgcatagagtatcagaaagaaatatttatgatttttaaaaaagtactctcattttaactgttattatccattatagcttagattgtatatttgtaatttctctggttgttaatacagtgaagttagctagtgtgttgcctactttattttttctaaaaatctatgattttaattaactaatacatctagcatttatagatctagtatttatctctcttctaactcattactttctccttttttctttattattttctttcttgtgctttcttttggtttatttgattgctttttttagctttttgagatgggaggtcaattaatttattttcattccttcatttttattgatgaaaatgtataagactagatattttttctttgatcatcattttaaatgtatgccatagattctcatacacagtgttttcattattctttgtttagaaatcctatcatttttgtttgtacttcccactttacctgcgagttttaaaacagacttttcttaaaattccagtcggaaggccttgtgtgctttcttagtttatttataattttttgtttcattacattgtgatcgggtaatgttgtttgtaaaatttccactttgaagattaaacaaagcccaaacagtcaaaaagttaaagatttttaagtttatatatgtgtatatgcagggtataaagaataaaaaatgattattattgtattccttacaattaacatgaagaacttctgttcatcaaaagatactattaagagagtgaaaatacaagccacaggatgggatatattatgtgatacatatctccaaaatttttttttactaaggatgtgtaaagaacaccaaaaatcaacataaagaagacaaacaaattaacagaaaaaatggcaaaagtgtagaacaggcactgcacaaaatattccaaatcactaaaaaatatgtgacagcatggtttacatcattaggcatcaggaaattaaacctatacattgccactgtgtgtcaacttgagtggctaaaagggaaaaaaatgccaaattttagtgaatgtggagaaacaaactgtgatacacagctgattggagtgtaaatttatatggccattttgagacttacatgccactttggtagcatataagaaagctggatgtatgcaatgtcctatgatctagtagttccacatacaggtaaatacttagggaaatccacacacgagtataattatcaccaaaaaatatgtgcaagattgttcatacagcacaatatataatattgcagacacaatgagtagaattaataaatgaattttcctacattcatatgatgaaatacgttgtagcaatacaatgactgaaaaactaccatatccaagagcataaataaaacatgggaaaattatgttgagctaaaggagctaaacacaaaagactgcatatcatatgattctacttacataaatttaaaatcagacaaaaaaaggccattggaggtaaggatagtagttacttttgtgggagagggatcaagataactgagaactgtgaagggaaacaaaggggacttgtagggaattatgcattatactaacttttaatttgagtggtcattacataggtatgttcactgtgcaatttcatagagcaatatacttataatttctatacttttacatatgtcatactgtaatgactaaatgtatgtgaaaaattagaaggcagaggacagtgtggcagaaagtacaaggagcttatcctcctgaaatttcatcttccaaagcaaggaatttcctgtttttttgcataaattcttaaaggtcattaaaaataattgtggttccaaactggtgttgtttttgaaattcttttagcttaaccctgaaggaaactttcaggaatgaatatcttttcagttagagaaattattaactaaagattcacctctttcttgttctccttccctttattttatcgtagtctagtaaaataaaatctagtactttaaaaacttgaatagcacatatagtataagctcatcattgtaaaatttatttctgtaaaattatctctctttctggctatctactagtctatccatttatttcatagtgaataaaaagatatttgtaatgattttgacccagtgtccgaactagctaattctggaggttgcaatttgatttaatttaatttatctgccttcatattttcttgcagtacttgatgttttttgctacaagctcttaaaacaattccagtgcttgatttttaaaacaataaaaatgttctaataaatttatgaagtcattgttctgtttttaaatttatgtataactcaccctgttatatattgtaagtgtaacaatatattgtcaatcaaagcatgtagcttattaacactatgattaaaaaccttaaaatcttgggcatgtatatgcaagattttgttcctttttaattttctattgaaaatttccttttgtgaatttacctttggttttgtcaactgacccacattttaagttttcagatttgatatatttgagattttaatagcaaaatcaattttttacacacatcctactttctctatgttcagaccagtttctatctatagttccaggtcactggaggtaggggcaggtttctcttttcagtattcctaatcttacagaaaacagcttttctcccaagcccttttgtcactcctcccttggacaagggaagactgatgtgatgggtcagattcaggagcactatcagcagtaccaccttccaatgtgacacccatgcgtgtaggacatggccatgctcttccctctcacaataccaaagtgataagctgagccagtgcctactatgaaggctgggctctgccacattactccctattcctttcttcttactggagatttgggactctgttttccacacactaggggtcaactggttataagatgcagagttagagagttggagagaccctgcttccttcttgagtctgggcctgtgcttcaacccagcttggcctgagatctctgcattgagggtcatgggaattggccccgtgaattatattcagggtccttgtgtgcgtgtctccttcagagaaaaccctgggaagagacagagcagcagtgtagggtaaaagtggggcatttttgtgtcctctggacaaatactagccccacactgtcagattctcaccagtatatacatttggatgtctctcactccattatagatggtatagatggtgacccgaatgtcacaactcacattgaagcatcacatgaaaccattccctaatcatgctaccatctagaggtcagtacttggtgttttcaggcatggttggtggattccatgcatgaagggataaggtaaatatctgttgatgtgaagatggtcaaggcctcctgaattccagtggttcccccacccttgtctctttcctcaggggctcatgcatcaacctcagataacaggaagccagtattctggtttttaaattgatctcacaaaaacaggttgtcttcatttgggcctcatttaagccctcagaactttgaacttgacatttatatgatccaaattgcaaatacatcccatggctgactcactcactggcttctgttggaattggccacttacggtcctcttcagtaattacttccccatatctaaataatcatcatctttccttgcatacaatgttattttatgtacttcattcacattttacaattgccttcacatagaaaacatatatcactcacttttaagacatgccttccagctatcactaagtcttgtatttcaaattttctccttacttagaggtagcccagatgtcctgcattatcactaccacttaccaatatagatagatgattaattgatagatagatagagataggtatgtaagtaggtagatagatagattagataaatagataattttttccttgtcacaaaatctcatgcaggtcaatgtcaactgtgaatagagtcaaaataggatgagataagcttctctttggtgatcagtttccaaatatgcttccacatgaacaggtggtgtcttctctacagtctctataatccatcctaagctgcctgttctataacagtttgttcactactggaaaatcagttctctgttcccataggctctgttcatgcccacattcatctgccatcccaaaataaaatcactactgagatcacactcatatcacatggtgccatcactcaaattgaaccctagagaaatggtaatgcactaagtattccctaaaacatgctcagaaaatgagaatgaaagacctcacgacaaacttaagatagatgtggtaaaatggtttctggatgggatgcatttttctatttaagttcatctgagcactacaagaaagacttggctaaaagactcagtatcggactgtgttaacaatactgactcacggtgaattataacacaacatataacttgagaaacattcacaacatattgcagcttattttattaacacacaccttggtgtttaatggttatagttgataatatttacctgtgccaggggactaatacattcatggctcctaaatgtaaggttacctatttagtagattttttatccaacaaattaaaaatatgagcatgagtaattttgctaaagagaaaggatctgataacattccagtgtcccagataaaggcatgaatacttcatcatgaaatattcaaaagattcccaagataaacattttaacaatgacaaatgaagcaggttatgatattccctacctgaaagaggaggtctccataattcttgtctgttccttacagagtgatattagggattttctaaaaacatactcccatcagaattctttcaaacctcacttacatgataaacttaaaacttattggtatgtgactttttttaaccagctttattttttagaacagtttcaggtacacaacgaaactgaacaggaagaactctgtatacacactcacagcctccctgactattaatatccgccccccccccagagtagtacatttgttacaaccaatgaatctactttgacacattatcacccaaagtccataatttacattaggttttacatatggcgttgtacattctataggtttggacaaatgtataaagacatgtgtccaccattatagtatcatacagaataatttcactgctctaaaaatatgtgttctgcctatttatcatcccttccttctaacttctggcaaccactgacctttttatagtctccttcgttttgtcttttccagactatcaaatatttaaactaatacagtatgtagtcttttcagattgacttctttcacttagttatatgcattttaagcttccttcatcatgtcttttcatggcctgatagctcatttttggtactgaatagtatttcattgtctggatgtaccacagtttatctattcacgtactgaaacacatctttgttgattccaacttttggcaattatgaataaaactgctataaacatccatgtgcaggtttttgcgtgggcataagttttcatcttattgagtaaataccaaggagtctgactgctagatcatacagtaagaatatgtttaattttgtaagaaactgccaaactgccttacaaggctataccaacaacaatgaatgagagttcccattactccacatccttgtcagcatttggtgttaatgttctggattttggtggttctaataagtatataatgacgtctcattgttgttttaagttttattttcctgatgacatacgatgttgagcagtttttcatatgctcatttgccatctatgtatcttctttggtgaggtgtctgccaaagtctttcgcccattttttaatagagttgtcttttttctgaatgtttagttttaagagttattcattcttagcaaactatcgcaaggacaaaaaaccaaacaccgcatgttcttactcataggtgggaattgaacaatgagaacacatggacacaggaaggggaacatcacacaccccgggcctgttgtggggtgggagcaggggggagggatagcattaggagatatacctaatgttaaatgacaagttaatgggtgcagcataccaacatggcacatgtatacatatgtaactaacctgcacgttgtgcacatgtaccctaaaacttaaagtataatttaaaaaaaagaaaaaaaaagaactacaaaaaaagagttattcatatattttggataacgttactttatcagatgtgtcttttgctaatactttcttccagtctgtggcttatcttttcattctactaaaagtgtctttcacagagcagaaattttaaattttaatgaagtccagcttacccatactttttaaatagaatgtacctttggcattatatctaaaaagtcatcaccaaacccaaggttatctagattttcttcgatgttattttctagtagtttcataattttgcattttacatttaggttggtgattcactttgagttaatttttgtggagggtgtaggttctgtatatagattcattttttacatgtggatgtccagttgtttcaatatcgtttgctgaaaacactaccttactccattgtattgcctttgctcctttgtcaaagctcaattgaatatacttgtattggaactactgctgggctctctattctattccatcgacctaagtgtctgttctcttaccaataccacactgtcctgattactgcagctttatagtaagtcttaaagttgggcagtcttccaacattttttttctcagcagaaacttcagaattaatttgtaaatttccatggaaatccagcaaaatcgccctgttgggattttgattggaattgcactgaatctatagattaaggtgaaaagaattggcatcttgacaatattgtcttcctacccatgaatatggaatctctctacatttatttagttctttgatttctttcatctgagacttgtacatttcctcatataaatcttttacatattttgctagatctatatgtaagcatttcatttttctggatactaatgtaaattatattgtgctcttattttcaaattccacttgttcactgctgatatatatgacagtgattgatttttcttgtatcttgcaacttgctataattgcttagctgtcccagaagtttttctgtcagttcttttaaattttttacagagacagtcacgtcatctgtgaacaaaaagtttttatttttctctcctgttatgcaaaccttttattccttttccttgtcatattacattagctaggacttccagtatgatgttgaaaagcagtgatgagggggaactatttgccttaatcctgatctagtgggaaaacttgtagtttctcaccactcagtataatgttagctgcaggtttttgtgaatgttctttaccaagttgagtaaattcctctctattcctagtttactgagagttttttttttatcataaatgggtgttggacattgttaaatgctttttctttgtctattgatatgattatgtggtttttcttttttagcctgttgatgtgatgaattacattaattgatttttgaacgttgaatcagtctcgcatacctgggatgaatctcacttggtcatgatgtataatgcttttgatacattgtaggatttaatttgaaaaatttcagaatttttgcatctatgtttatgagacatattggtctataattttctgtcatgtctttgtctggctttggtattaggtttatgatggcctcatagaatgaattatcaagtattccctgtgcttttattttctaaaagatactctaaataattggtaaaatttcttcaatgtttggcagaattcactgctgaactcaatttgacctaatgctttagttttagaaggttgttattgattcaatttctaaaatagatatgggcctattcagattgtctatttcttctgtaagttttggcaaattgtatctttcaaggaattggtccattttctctagattatcaaatttgtgggcatggagttgttcatagtatttctttattattcttctaaggtccatggcatctatagcaatgtcccctctttcatttctgattttagtaatttgtttcctctctttttttttcttagcctagctggagtcttgtcagttttattgatcttttcaaagaaccagcttttggcttcatggattttctccactgattttctattttcactttcattgatttctgcattactttttatttttttaatgctcactttggatttaatttactcttctttttctagtttcctacagtgaaagcctatagattttagatctttcttcttttctaatacatgcattcaatactacaaatttcccctgagcactgctttcactgcatcccacaaattttaatacactgtattttcatttaaaatatttttaaatttctttgatgcttcttcattgatacatgtgttattcggaattatgttatttattctccaagtacttgaagattttccagcttttttgttactaatttctaatttaattccatttggtctaagagcatacttgtatgatttctattcttttatatttgttgaggtatgttttatggtccataatggagtctagcttggtgaatgtttcataaaaatttgagaaggtatattctgctaatgttgcattaagtagtctatagatatccaccataccaggtgatttatggtgttatcgacttcaactacatacttattggttttctgcctgctgaatgtgtcagttgtgatacagagatgttgatgtctgttactataatggtggattcatccatttttccttgcaattctatcagttttcacctcacatatgttgatgctctcttgttaggcacatacatgttaatgattgttacgtcctctggaaaaattgacccttcatcatttggaataccccttttattcctgataactttccttgcactgaagtctactctctgaaattaatacagctattcttttcttttgattggtgttagcatggcatataattctccatctatttaatctgtatgtgtcatcatattcattgtgcatttcttgagacaatatatatttgggtcttgttttttgatccactttgtcaatctctgtcttttaattggtgcatttcgaaggctgatgttcacagggattatttatatagttgaattaacagctaccatatttgctactgttttctattcattgcccttgttctttgttctgatttttgtcttccactctttttctacctttcgtggctttgagcattttatatgattttattttctctcctttcctaatatatcagttatacctcttttttgtaactgtttttactggttgccagagagtttgcaatatgtacttacaactaatctaagtccactttcaaataacactatactgcttcatgggtagtctgaataccttgtaataataaaatattctaattatttcctctggtcccttctataatagctatcactcatttcagttatacataagcacacataagcatatgtgcttacacataagcatacataactggatatactgttgctattattattttgaacaaactgttatctgttcgaccaattaataaggaaaataaagttattttaccttcactatttcttctctgatgcttttcccttctttatatgtatcttagtttgcaaacctgagagaaatatgagggaacttcagtgatgccttgaagcatcatagtccaagcgtattgtttattctatgtgaaaaaaagacagtgggagtaaggaaaaggggatactaaaaaaggctaaagagagacctactactatgttcaatttggaggcagaaaagctaggataatatttgtgttggggaccaagggaaatgtgtacattatgtaatttatatcccttaaatctttattcatagagttattcacattcatttggacttcttatctggagatggggtgctgcagagactagtacaaggaatgagtaagcccttagctatgaaatctgcaacaatgggctgtattccctccaacacttacagttttaggagatactgggacaatttaggcagaagcattatggtgtcagtattgacttgtatggctttaatattacttatttaccccatgtctgcagatgatgtggaccagaaaatatggggtactgaaaaaaacaaatcagaaaattaaggttattctagggataagagagttggaaacagtgcaggatagaaaagggaagccaccataagatggtacattgggtcatcccattcagggagatcaagaaaaaatctttcagatatgcacctaatcatgactcctcattgagccaaaacatcctatcctgataggttggactgggtggaaagactgaggagaaaggcaagttaagatgtgaagttacctaaagaggtgggcaaaggggtaaagagaaagaatatattcaactggtaagtcacaccactgaaatctctttattacttcaaggtaagttggaaagaaattgggaggaactattggtgaagactgtggctccaatgtctataaaaaagtagatgaccgtgatggttaattttatgtcaacttagctaggccatagaaacactactttagatgcttctataatgatatttttaaaatgagattacaatagactgaataaagcagattaccttgcataatgtaggtggtgtgtttcatccaatcagatgaagatcttaatagaaaaaagactgatgttacccaaggaagagggaattctgccaggagatagctttcagacacaagctgcaaggtcaacccttgggtctccaggctgctggcctacctgcaattttggacttgacagcctcacaatcatgtatcagttccttaaaatacacacacacacacacacacacacacacacacacacttgttctggttctctggagaaccgtgattaatacaatggccatttactaacagagttctttctctttgctaaatcaaaagcaattggagacactaaggacagattccttgggaatcatattgtttccaatcgagcagctttttgggctgcttgtgtcctggtcaaagcaataaaattgtaggcatagtaacatcctcctcccaatatatgcaagtattcttgcctatctgttttgtatttgtggagggtcttttgtttccctcaagttaagctgtagtgttgcaagtttttgcatgtagttttatctttgtttttcagggtatcctcaaaatgctggactaattgttgtaactcatgaatgggtattgtctgccagcctattttctgcttctgaacagcagctgatatttcaggcttagggctattaacaaaaaaggtggtaatttcaatgctgatgttagcattaattcccaaccctgagcattctttaaagtgatttacaataaagattcattccatctctgtcaatagggttagactgttccccagtaactgtgagagggataaacttcaatataccatttaaaagaccttcttgtatctatagggcatcaaggttagcctaaatcctcatttatggtaacccatttggccttgtcacaccaggttctagcacctccaggttctactaaaaggtgtgttaactaatgtaaatctggaagccatttcagtcagcctcttagtcagtaggaaatcctctcagattttgccaagtagttggcagccaaccgtaacttaggaaactgaaatcacaaagaatggggataaaaataagtaacaggacaggtggttagggagccttttcagccttctattaagaatagagtgaagttacacaaaaaaagattgagaagactacataaaagtaaaattatctatgcctctgaaaactacacatttaggaagcaaaaaccaggaaaagtatttgcaatgtatgtgacagaatggaagatcagtatcttgacatataacttacaatcattaagataattatctttaaaacattgataaatactggttagggtataaaaaaaacaagaattctcacataatgtcagtggcaatataaatgggtattgtgtttcttgcaatgcaccaagagagttaaaagcgatcatgcctttcaaaccagtaaatctatttttggaaatctattataaataatcagagatggtaaaaaatatatgtgtgcaaaagtattcttttcatttaatgaagggataaactttaagaaatctatcaatgtgctttcctcctacacatttccttgactgaatggccctaaaaactagtagtatgaattttctactagaaggcagaaatgggaaattgaaggaaaggtgtcagctctatgtaaatctgaagagtacattttatcaaactcggtctcatggattgcaaatcctaatacacacattgttgtgaatactggagataacaacaacaataattatatgtctacaattgccaggaactaagaacctgttgtgctatttatggtgaccaccatcctccatgaagcacgtgctattataaccttcattttgctcacgtggaaactgtgatacaggaagaagcagtaaattgccaaggttcttggggttcctcaaagagggcactggcgttcagatcaccggtctatcatacacaagattatacgctggtttacagaacgttttcctgcctccagtgcaagaatgaaataaaagacaaactgggtagagtgtaaaacagccagcaaaacttttttcaaaatggtaataatttaatgctcacaataaagtgctaagtggaagggtgagggggaagccacgttgtttcatccagtatcatccaaacattatttaaaaatacaccgtatttacaaagataaacatctggaagaaataaggtacttgttcatgtattcaaaactgtatgttaagaacactcctctacactcttgtcagtttgccgaaaaggcaatggtgagcaaaaacaaagcagaacaatcacagtttctgttcttagaaaggttacatgatcacatttaccaatgagatagggggtcaggggttatttttgctttccatttcagttattaagtattttttcgacgcttctagactgtgtattgttttagaatgggaaatgaataaaaattttcaagcatttttcaaatgatttttaggacacggtaactcacactgaaaatctgagtttaaaaaagatgaactaacgatggaatatgaactcgtgtttaaaatgcacctttgggaatgaaaaactctaaggaaacaacaaatattatcagtggtcattgctgggtgatgggactgagggtaagactggctttctttattacactgtatttgtcctccaaattttctacagtgaggttgagtcacttccataataaaagagtgcgtgcatttatcaatataaaaccaggtccacaaagcccagtacaacctggggacagtgaatgacaagaccattgagagaagtcaaaatacaagttactaaggaacctaggcatcatctcaagaggaatgccaatttcaaaagcaaaaagattttgttcatcagctctgagttttcttaagagacactacccgctccgcttcaccccctaaaaaacaggcagccccagcagcaggacttggcaggtttaagaaccaacctcttctctcaaaaaagattccgcggcatttttttcaagcaagaagggcggggggagaggcgagttgggcgtatccatggagcaatattgccacctgcaggccacaagaatgaagcgccaccaaccgcggaagaaaattcatcctttctactgcttctcggcaaagagccggtagagctaacctgaggaagctacgcagaatgaagatgaggaccagagaatagactagtaccggtcagacaggccccgacgaaccggccgtacaaggcagcctcccatagtcccgccctcggaaccatagcaacccagcaggaagttcctgcgccaccggaaaaagcagctctcggggcggggctggcctaggattgacgggctctgggcctgcgcatcggagtccggggaggtaggcgctagtctcctcagggtcagccgcaggactccttccctgctattgagagttgatggctcaggctcgcgaccgctgaaggccaggctctactgcatggctgcaccagccgcctcacgttcgagacctgtgccaatcccatggacactctcccagccagcccctggacacgcttctcatgtgacgcacgccctgtcctcctctcagccctcacagcacggatcctccccggcgacctcagcgcccccggggctgaccaggccgcggccggctctcctccgtcttgagggggcctcctcctccccacctaagtctcctccgcgcgcggtaatgctctgggcctcaggaaagaccgcgccccttcacgatgtctatttcttgcatcccgcactctcatcatgggcagcaccccatccagtcctaacagctccctctctccaatgtcccagcatccacagccttcagcctcaaggaggcctgtccactgaccccaaccgcgttcctcaccattcaccttccttacccagcttactcaaagctattaactctcgctcctcaaacgcatctcttcattttccttcctccctactcgcctggcaaccccctgccttcccccgcccccctgtaaccaagtagacaaacaatgtgcaccctccacaagtgtaccttctctctcctctccctacaatagcccccacaaggactagcaccaactcttctcatgatattccttgatattcccctgaaaaaacaggagcgattggagagaaactctcaccacttcccaacagcagtgggcctgcacttgtaatctcagctgccccactggaggaagtgacaggatcctacttgaggccgggccttcacctgaatcccatgccctctaccttctcaaggtagagacttttgtagtgattatcccttattcctgaattgtcacattctttctttattctggattcttctgtcatctataaacatgctcttgtttctgacattttatacaaaatgtaataaaacagaaatcagttccttatcccatatttctccaaggtaatgacacatttccctgatgctccaagcagcaaatctgtcttcccttgttctataatcattatcattacaaacctcttcaatgcagcttctacctgctcacctctcaacagaaaaatgcttttgttaaaggcaccgatggccttcatattgcctaacactatgatcacgtcctcatccttttacactatatgtccagatgccttcagtacatctgacacctccctccttctcaaagctactctcctccctccttctttatttccctccctgtcttctctcctctttgccctgccttgtttttcttcttaatcataaaattattttattgatattttaagtggcataaatacaataaatttgagggagaatgaggaagatgttagctaatgaataggtcatgtaggcctccacaaagcttcaggactaatacagacatgaacagacacctgagcttgcccttgtaactccgcgaacacaccacaagcttcaggatagtttgtctctgatgctcaagtagtctcaggagttaccagacaatggtggggagagatagcttagaagtgacgctctctgtacacacatataaaaaccgctgatgcagcaccttgtaggccccttttaaagcgtgatgattcctgtgatggttaatactgagtgtcaacttgactgcattgaaggatgcaaagtattgatcctgggtgtgtctgtgagggtgttgccaaaggagattaacatatgagttagtgggctgggaaaggcaaacccacccttaatctgggtgggcaccatctaatcagcagccagtgcggccagaatgtaaggcaggcagaaaaacgtgaagagactaggctggctcagcctcgcagcctacatctttctctcatactggatgcttcctgccctcgaacatcagactccaagatcttcagctttggacccagactggcttccttgctcctcagcttacagatggcctattgtgggaccttgtgatcgtgtgagttaatactacttaataaactcccatatagatatatatatattacttttgtccctctagagaaccctgactaatacaactccctttgaactccaagtttatttttacagagagcttgtcctgctactgacagtgtattgacttgtatttggtaatcccttccattttgtgtttctttatctgttagtcaatctccttcaaacattccaaataaatttgaattctacaagagaaagtacaaatcctaaagccttccctttatgatctggatttaatatgggaatccttatgtcaacatgaaagataaggaaaacaaaagaatgttctgttccagtcatgggggagtagaaggcatggagacagtgtctcatcccagtctctcttctaagggccttatcttacatgtgacaggtgtgtcagagaagtggaagggagttccaaataaagagatttttgcccaactgaaatttaggactcagaagtttacttttgcaggatgaaatagtgagctccttggttagaataatggctggagttcaggaatttctatttttggagctgatcttggttcctgcagggagctaacattctctgagagggggactgtggaagtggctgattcaagagccaggggtgctaccatgaaacaagcataagccagataggggctaggtgaccctgcagctgaggctgtggtgtggacagccctgcccagatgtgggagggagatgaggcccagattcagaggggtctgctgatgccagcacgggtgggccaaggccgagtcagcctgggagcaccagattccctcacaagccaccgagaacactgcaatcaacataagatgtcaccgaccccttcccattatcaccatgaagactggaaagccatacgcaccattaatcatcttggaaaggagtagggaggtggggcagaaaactgggagactgatcattttcagcaaaacagggtgagcatttatacaaatggaccattcacatgatagcatcagctgacaccagattaaacataactccagtattttctcaccttcttgtccagtacagaggttatacattcataatgaagatcagatcagtcttagcaagtaaatgcatcaaagcccccaatcaggtctgagaagcacgaattaatttgtggtctctgcacaccatctcttccagctccccctctgcccactgtcttatcagtccgtggaagagggcattgagacatccttgcctcctcttctcctttaaccgaggacaattttaacctgttataaattgaccctgacaacagagcacagaaagaggagaggaccagaagagagacacacagagtggagtaacagatgagagttattgctgaggtgagcagggcctcctcaaggcttacagctgccctccacaagtgataccaggctccactgccctttatgaacacagaaattctttctcagggtctatgccctggagcttagagtcagaaaatattcgtagctctgtgtactgctggagaaaatcacagaaccacatgttagaaccactgcattttcatagtcatcattgtctcctgggatctcagtgcccagcagcaggctttcttggtgactcttgtcccccctccagtcccttctgaggggatcccaagatttctcctctctcctggaaccctctaccacacatctatcccctcgcttttagccatagcaaattcccattctcacctgagatccaagcaggtagtgagagggaggaaggcctcagtgctggaaaggggtatggattccgttgtcttggcaacattcttcttcacatcggcactgggtcactcagctcagatccatggttggttacctgggaaactgaagctttatccatctgactccagagaatagcaaacaaaagagtggaaactaagaggattatcatgggaggccacccacagacatggaatcgtgactctcaatagatgtgtttgtcacaagggtccttgcacatgcagagacaatgtacatgtgtttactcagtagcactcattgctccctagaggagcacagtgactatggcaaaaggtacacattggggaggcagaggatgaggtgggaatgtaggcacgtgacagatcatgaaaagcatggaacatataatatcaacgacaacctcttcactgaacgtaaccaagatgctgtctcacagtcccttgcagccatgagtgagcacctcactgtgagggtatgggcaactgcttctccataatgtacaaggcccctcttcaacggttgaatttgggggctacatttagaactcataaaggcaaactattcccaatatggtagaaaaacaagtccccagagctccaaccttccaaatctattaaggaagcccaacatgtggtaggaaactttggattctggcaccatgacattcctcacatccaatatttgctggatgctatctatggagtctcccttaagtcttctgctttccagtggggacctgagcaacagacactagagaaactaaaggaagctattacttctcttctctcatctgctccaaaggcatgacttacaatgagaattttctgccatgccaaatttgcttccaggcgcctctggaccaaatggataggcaaacacctacccatcagcttttgctgtaagtggctcccagcctaagcccaaagatattcaccatgagcgaggcaccacctggcagtgtactgggcacttcttaaaactaaagcccttactggggtagagccaattaccctgttatgccctgcacagtggaagaagctctccttaaaactgaatctgcaacagagactcccttataaaatggtcttcccagaatccagctaaaatcaaccctactggagtgtcacatcccatgagcaaatagccacatgccctgcccataaggctaacttgccaaacctcagaaatggcttcatcccttgctcaaggggagccagagggaggaaggccagcaccctaaaaacaagagaagcaatgctttttttcctctcccaagtatattacctagacaatggagatataattagcaaatccctgtagttattttttatataataacctacgacaggatataaacttaaaaccacatttatcctgagtaggatccactatagttacaggtttggtgattataggaaatgtcaagacattagggaaattgaattttccttgcaggatccatgaacatcttcaaccaaagcagaaatagcctaatcagaagagaggtgagggttcaggtcaccaagtaaggttcagttgatttggggttggaggagcttcaaatcttctaaatctttgcataatatagccctgataatttaaatgaggcagtgcttcataaacttggttgaaataagaatttcaatggagtcatagtttatttaaaaagaaaaatttacctccaaggggcagatgaaagagtcagtgttcctcttctgactgaaggagaaaactcacaaatgtgagtttaatgtacatcttaaaagaaaacagaagctgtgatcggtggttcacatgtataatctcaacactttggaaagcagaggcaggaggatcgctttaactcaggagttcgagacatgttgtctgtcatatgtgggagctaaaaattttgatctaatggagtagaattttggtgaccagaggctgggaacagggggtgggtgggatgaagcgaagttggttaatgggtacatacaattaagtaaaaggaataacttctatttgatagcacagtagggtgactaatggtaacaataaattatcatatatttcaaaatggctagaagggaagatttgaaatgttcccagcacaaataaatgataaatgtttgaggtgatggatatcctaaataccctgatttagtcattgtcctttgtatacatatatcaaagtgtcacatgtaccccataaatatgtacaacaatgtatcaataaaaaagaaataagtaaacaaaatacaatctaatttacattggtgtatgtatacacaatggaatactattcagtcatataaaagaatgaaatcccatcatttgaggcaacatgtatgggcttcagatgtgtgagcctggaggacattaagtgaaataatccagacacagaaagataaataccgaatgttctcattgatatgtggaagcttaaagcttttatttcatagaagtagagagtggaatcgagattagtagagtctgggaagggtgggggatgaacaggtagagtttagctaatggatacaaaattaagactaaataagaggaataatctctagtcgtctatttagcactgtagggtgactatagttaacaataatctattgtatattttcaaatagctataaaagaggattttgaacgtttccaacacaaagaaatgctaaatgtttgaggtggtggatatgctgattatcctgatttgatcattacaagttgtgtatgtgtatcaaaatatcacactgtaccctgtaaatatgtacaattattatgtatgaataggatatatgtacacacacacacacacacacacacacacacatatgtcctaatttactaacagaaagctactagctcatcaaggcccccttcctctccttccctttcctatatgacctaccacactcataagttatctaaaagtaagtaatgagaactgaaaccatgcacacagcttactgcctatatgaacaagagtttactattccactggcttcattaacataacattattactacaataatctcttgcctgcgaagataaaagttgaacataactttattattgattctaggaactgcataaaaggcctatccactgttcagtaaaaagtgccaaatggcattttacaacctcaagactctttgaaccacttgccttaaaatccttgacttgctgtgtccaccaaacctaaaaccagcatatcactattcccacccaatcacatccttcccctacattgaaagacctgctttatgccagatttcaaaatatgaataagtgtcccccaaatccttctacctctgagactctgctaagaccctgttcaggaagtactcttccttacagccttatgcaataaagttagctttgcttatcaacaagttatttggctgatatttggggagtacagcatatgatgagtatagtcaccactgctgtacttcatgtcagagtagactgagcctaaatcctaggtccagtatctatggatatttctgaaccatgcactgtgaccacaggcatattcagggaaatcagttaccagtcaggagatttaaatgtaaaagaacgtaaccaaaaaaaggaaacaggtcttaatgtatttattctacgatgccgctatggtcttgctgttgtggcgccccctggacagggtaggaaggtgggccatagaggggaggtggatcagctcagaaaagggtgagttgtgaaaggagacactatctgaagtatttgagtcctggaggcatatgaaactgcccacagataactgattctggagtttttagtggggacctgggaaggggcagggtggagtaggatggggcggggcactgcagtctaagaggcaagagccggcctcagtgcacatgtttgctgggtgtcttcccgtctgccccttcgcactgcgtggtgaatgccgccaagctgcgcgggtgctggttacattcctaccgtctggactctttctggatgactgagacacagctgataggtccataggtcagtcctcccaggagtttaagtgtcagtgaagtgtcaggtggagttagcaggctttgggcaggtcaggcagtgtggtaggtggcttcacagcgggaagggcctggaggtcattgttcttttaagaggtggctattctgccgccagccttgtcgttgtgggacaggggaggaaagtgggtcatggaggggaggaaggtcagcagaagatgaggtgagttttggaggaggacattatttgaggcatctgagcctttgaggctatgaaaccgcacacagaggatggattccggagtctttagtggggaactgggagagagggtgggacagactggtgcaccacagctgccatgaatggtgacaagttggacataaccaggtccacatgtgcttgtgcctttccacaatatcaggcttttattgatgctaattcagtcgtaaaagccacaagctacacggagttcctaaggaggcagttctccttagcacttatcgttcacctggtagttagagcagcaggcacacaaactcaagccactccacaagtcagtcagtattgcaaaccatacataacagtatgctaaatcaatttataagtgttataagttaaacattccacaacaaagtaacacttttcatcaaagtaaaactttttcattgagaggaaaaagaggacaaagggttaaggaaccagtccagggggggtgaagaagacaaaaagagtcctggtctgggctgagtggtccatgggtcttgcaaggaagtctttgacgtggcagagcctttggcagcaaatgccaagttcttgtcatgattgattgcaagaaggtgtcagttaagacagatgtttgaaactgctgaaggcctaatcttttatagtcacagggtcctctggtaagagctgatcgtggaagagtgcttgtttgtgtccttatctggttggatgcagtcttcatgttttatttgtttattaaacaaaacatgctattattgttggcaaagtgccctatgaaatataaaatggagtatttttctaagatggtgttagttatgtcaagggtgctctatacaatctactccaagattttagtaatcataatgcaaacaatgtttgaggaaggggttacaaaaataaaaaatgacaagtcaccatgggaattaatttcctcttggtaacttgtttacaattttgtgttacaaaggctgaaaacgcagatcttaagtatatggtaagcaaagaggatgtttacaatgaagatgacaacgttctgtaaatgttcacagatatatttagaccaattccagagtccagtttttaatatattgattgggttccagtctgaccatgagccttcataaggggtatggctaaaagtcttcttaatcatttggaagaagatgcatcttctgtgtaagccatctagtttgaatgctattttatttgtgtttagtattgctagtccatgtgttactacctcagtggtgtgttttaattgtgctaattctgtttggaatgtgtcatgaacttgttgaagttccttagagcttccttgtgaaagaggaaaagttcccttatcccctcacagggcatgtgatgtgggtgtggcttgcttcttcagtgcctgctgctcaaacctctagggggagcatgcagacaggcatgttgtggggctctgaccccaaggcagtgtctaggggtgaatgcttacagctcctgaagccccagtgggagtgtgttacaaggtgctcttttagtttagccatctgtaggcagcttgtgttagctcaattagactccctaccttatcgcgaggacagagggctttctgtatgccaggatttcttgccttggtgtactggaagaatcagatcacatgtgggtttggagaatgaatgcaatgttttattgagtggaagttctcagcagatggatgttgcaggaagtcagggaccccaaacggagggactggctgaagccacggcagaagaacgtaaattgtgaagatttcatggatatttattggttccccaaattaatacttttataatttcttatgcctgtctttactgcaatctctgaacataaattgtgaagatttcatggacatttattacttctccaatcaataatcttataatttcctatgcctgtctttactttaatctcttaatcctgtcatctttgtaagctgaagatgtatgtcacctcaggaccctgtgatgattgcgttatctgcacacattgtttgaaaagcacgtgtgtttgaacaatatgaaatctgggcaccttgaaaagaacaggataacagcgattttcagggaacaaggaagataaccataaagtctgactgcctgtgaggccgggcagaacagagtcatatttctcttctttcagaaagtgaataggagaaatatcgctgaattattttctcagcaaggaataaccctggtaaatgcatatctgattgccttctttagagaggctcatcagaaactcaaaagaatgcaaccatttatttgtctcttatctacctatgacctggaagtctcctccctgcttcgagttgtccagcctttgcttcgagttgtcccgccttttccagactgaaccaatgttcatcttacatatgttgattgatgttgcatgtccccctaaaatatataaaaccaaactgtgctctgaccaccttggggacatgtcatcaggacctcctgaggctgtgtcacaggcatgtgtgctcagccttggcaaaataaactttctaaattaactgagacctgtctcagatattcagggttcacagttataataggtcagtgtgttgttcctctctaagcttattatctaattgaagtttcataagtctagagtcattgtggggattttcgtgatgctgatagttgagtaatctagtttaggaactttgtcctgacaggtagagtatatagtgtttgatcattggaatattaattctttttgtataaaataaccatcaataaatagtggtctttctaaggcagttatatgtagattatgtcttatctttctgtgtaattgccattgtgtcttatgccattgagtctcctcctcttaattcaagtagatttaatatacattgccctgaatcctgatgctttggatgtatccaatttaactatagacattttgtcccaattttctgtgaataattttcctgatgtgtataatgttccttatgtcattccaagtctgagttagtaaaatacttagcctaatacactgtgtttgcagcaagtttttcaccataaagtttcttaatgtaaataggttagtttttaggtgtttaacttgtgatcaatattgtaattgaattccttttgggattctgggaggtcgtgtgtatgagtcatcattgactatatctcgttaattgcctatgagatagatgaaagtatagatgtggtagttgtttgcaggagttacgtttatgttcataggtctgtattaacttcctaaatttttgcttcttgtattcctgaaatgactgagtttgaaataattccaattgctgcaaatagttgtggtggttttcttagatgatatttatctagtgaaggtaaatttggtaaaatgaactgcttgtcatatccttgtccctcaaattacataacttgtggtttgatgtatgtgactttaagttcttttttgaaaaatattttgactctcctaggtgctggtttgtaaattaatcttaatgggttaattaggataggttcaactaaatttggttttcataatttagatagagggtttgttattcctttggtacactgtggtgtccagtggtgtgttcctaagcaatgtgtcagtccagcatcctctgcgaattatgcatggcccaaggttctggggtttaacatagcattttgcaaaagagatatctctagctacaaatacaggtaagtgggagtctagtttggctatattttgataaataggatgttggactgaccatataactttattctatgatccatcaaatggctgaatcatgaagaaaaagtaatttgacatacctgagtctatttttgtgactttatccatatttattttggttcctagtgtttcccaccagttaattgacttaaattgtgtattgtttctatctacatcttcaaaattaaagtttacatcatcctgaattaccagtggatacattgtaaaaataacttgattttgtatatacttagttttcctggtaaatttgtctaatatagttatgtctcttggttcatttcctgtaaagaatgtgccaataacctctgctgttttgtaggtcagtgtgaatggtccaagtactaagagtgagttagataatagcagattgtatatatctggtctgtgagtagatgtgaatattaattgttcccattttgtttgttgtaatttatcaaaaataactgtttctaatgtccagtttctaatgtccatgggtttctagaagatgtcgacatccagcaatcagtaaatttagtagggattttctatgtcattgtatctattgtgatgactgggaactagtgtggtttttgtggttgtgtccaacataagcctgctttggtttctgtcacattccaccatagagtggactttccagttatgataacatatctgtctacattctctataaactctttgcttattgtgtaaaggtagttttgatatattgtagccaagtttgccatttaatgttgtaaatttagcatgtgttttattatgccaaagtctgaattgtgctgtgtctgttggtttgttttgttttgtaaagcctgttgatcttggaacgtgtaaccatgttagtaagcaacttatagtgtagaatgggcaaggataaggttttcatccgtgggataatgaaatgtagctttaatatatgtaaagttaaggttaaagcatattaatgttggttgtccctcaaaatgtatatcttgttgggtagtgttgattctattttttatctttataagttccttatttgtggagggcaagtataagtatacttgtattcaagacaagctttatctacatacattgttttagtgtgtgtttcaaaggtagtgtgtgtaaagtgatagtcagcattagttaagattactgggtgtcatctatgttttcaatataattctgccagtgagaattttttagccttattaaagaattgttactccagctctcttttgtctaataaaaagaaaaaagaagaattgtgagactgtcaaataattttggctttttgcgtaataatcataagatgaacagggtgggtgaaggcaaaatttccaaaaaacagcaagttaggaaagttaattagatgatagttatagtatgtcttatcctcttctgttgttattatatcataatctaatggatatcctagtggcattgacactttttcctgtgggggtctgatatatgggtgtaagatgaagtggttggttttgtagctatatttagtcttgtgtcatcccttgaatctacttcataatcataatgttcatttccttcaagtccagattggtaccagaattcataccaactattaacaaatgacttgtaggagtgtcgtatcatatccaagcatgtcatgtgagatcttccaacatatggttctatctgtggtactatgattggggattggtatgatatagcgcttcttatgtaatgaactgttttgattggcatgtctgtttctattagcatttctctacctattatgtgagccatccatggtttgagatgttattgaatgcttcattgtagctgcataagttggggtgtcacatttagtcatgtcatttatgcattcttctaaagtatgtttaggaatatgcgcaaagattctataaagatacaatgattggaagtgtgtgtaaaagctaaaagctcttcaggcattgctttgggtcaaatgaatatgaacaaaatagtctaattgaagctctaagtattcttttatcagtcccttgactttctaacaattgttcaaaaatgatatattttcatgaagtatatattgcggaatttgttctggtaatcgtgtgattttaggtgctgtatgagttggcactgttggatatgtatgtgtttgaggctcagaaattttaatggttactttaggaataaacagtagtagcagtagtagtagtagtagtagtagtagtagtagtagtagtatctgttatttcccttctatatctcctaacatattttaagctatttgcatcaatcttatgtttgctattaattatcagatgtataggcattaaatatagcactgaaaacaaactaagatataataatctatgtcatcctaatatttctctaagtagtatagtcaaagattgcttccagtagtagtattgctgctgggttaggttggggtagaacaaagtaaggtagttctatggggtctgtcctctcttattaagcagtttagcaatgcaacttatataataggttagtagccaagcaagacttatgcagtcattggggtgtacactttcaactaaaccttcaatagctcctaatgctgcagttagttcataaacgtaaggagcaggaaggtggcagtggcgcctagattctacaaagtctggtctgaaattccagtccatgcctgcctgtatgggccagtctgcttgagctaattcctgaaggaaatctggtgaaggggctctgaaagctataggtggcgaacatgaggctgaagcttaaaaggaaggagggcaaggcgggatatacatggatgatggagatcctggagaggctaagtccatatgctggggatgcattatagctgtcagtctgcaaattattaatcaaataatatacttaacaagcagatagtgaaatttgtaatttttctgctgtgaggggtgtgtgtgcttgtgttagtttgatttatctggttacagtctccctggtggcaatataagtaataacaaggcagtaaagttactatgatggctaatatgaggtgaatgagaaagttgataagaccagttgagaagctacacaaatttgtagccatcttgatgtcctaagtgagtaaagtatttaattattccagtgatagctaggagtgatgttgaagttaaaaatattagattagtggtaagcaaaattggattgaagtacaccttcacttattctcgtggataatattaatgcaatgactagaataaagcattgtaaagagagattggagattttgtctaattctaactctcctgtttcctgtagtctaacatgtgtttccgtgtccatgggccacagtgtcctgttgggagatagtgttgttatttagtctagtgctcaccttgtaaggtataatatttgtatcatattcttccttatcttttgtgacagttaagtttgggtgattaagataagaatggaggctgctcttatagtctttctctttgatttaagttgaaacatgccaggttaagagcttgttgaaatgtactcatttggtctaaggctttccattctctttttattagccattaaatctttctatatatcccactgctgtaagattgcaaggtaggtaaaaatttaattatatatcccattggtccaccaatgcttgtgtggtccttgatgtaaaatgagttgcttgatcactttcaatcattttgggggctccatagtgagccgcccaaatttctaaggctgagatattatatttggcaaatgagtggctagctgctgttgctatgccaatccctttatatatatccaccattgtaactgcatatttttgttagtaggagcgatttaatggttctataaaatttacctgtaagcagaaattaaagatgtcagatttgtatgtatattggtttagtatatttatatttgtccagattagttttacattattcacaattacctgtagcctttttaatttgatgtcatgtcaccttttgatttctgacagccacttgtacagtgagtgtgtgcctaaatgtcctttctgcttacgtaattgtaggagcatttgtggaatgtaagctgcttctggtgtctgtttaatttttttttttcaggtggagtctcggtctgttgcccaggctggcgtgcagtggcacgatctcagctcactgcaacctctgcctcccgggttcaagcgattctcgtctcagcctcctgagtagctaggattacaggcaagtgccaccacgcctggctaatttttttgtgtgttcttagtagagacagggtttcaccatgttggtcaagctgatctcgaactcctgacctcgtgatccacctgcctcgtcctcacaaaatgctgggattataggcttgagccaccacactcagctgtctgtttaattttcaagtcatacccctgtttcattatagttattggggggtacttgtactatctcacattcattgtctgattatctcctgagttgtagaagtggtaatgaatgtctccatgggttgtctggatttctgtgtagttttaatttgggtatgttttgagtgtcaatgtttatattccctgttaatgcatctacttggttattaaattttgtggtctctgaattgtctttttggtgtgctgattcatgcatcacaaatatctaaattcagtttgataattcatatagttccttccagtaagatgtggactgtatgtctttaccattaattgtaaaattattttgttttcatttatgtgactataggactatgccatttgcaactgcccatgagtctgtaaaaatataaattttctttcaattttctgatagtgtctgactggtaggacagctgcactcagttctgcatgttgtgtggggagagatttacctgcttccttcaggattgtttatttctggggtctgagtgctgttgctgtccgttgggtctggctttgggtcatggaggctgatccctctgtaaaccaggtgttggacagtacatcagactacactgggccccatttacctacatttgcatggattgtccctgtcctcagaataaattccagcaagtttatttcagtcttgtggatctccttggtgaggaggcctggttgacccttaaagcctgtatctcgaccctggatgtaccatttccatgcaatcaatttggatacctatttattcttcaggactcaattttatccagtgaaggagaggtatatggtatctaatggtaatggtgttgttaccagtcagaggctcaatgtttgtgagggcttcatgtgtaagccatatatatttttcaaatgggctatatttgttgtttagagcatgggaattttgttgtccaaaatccgaccagtaggaaggatttagaatctggtttctttgtccataatgacaatgttccatattcattgctcattaaaattttcaacctaagttgtgtatctggagatggctaatgttgtgtttggaatgtggtaatgtagtctttgagtgtttcgagtgcttgtgtttgttcttgtcccgatgtgaagtcaggatttcctagtcatcttacatattggttttaggatgatgtttaaatgaagtatatgttgtctccagtatccaaatacatctgcaagtctttgtgcttcctgtgtattctttggtgccttaaggctttttattttatctaccactgtggtggggatttttctcccttttaatgaccactgtactcctaaaaatttgcaattggtgtttggacctgtgtttttatctctattaatagtccatcccagtgatcttaagtgtgttattgagattttttttcttgtttaagtgtttcatggtcattgtttaccattataatgtcacctatatatgatattgttagtgatgtgtattttgactggtctatgtgtgatgataaaatggagtgagctattactggacaacttaaatatccccgtggtaatattttatattggaattgtttgccttcccaggcaaaagcggtatattcctgactttcttggtctattggtatggcaaagaacatgtccaacatgtctatagttacacagtatttgtcattacagttagtgatcttattaatgacttcttcatctggtaatactcctggcattttaggtatgactttatttaaatttctatagttaatagttattctatagctcccatttgggttcaggacaggccatgctagaccattaaagttatttgaaatgccaattgtaataagttcttccttaagaagttctagaatctttgcttttatttctttgtgtcctccctttaatggatattgtttactgtacgcaacctggtatggtgtagacagtcttatgcgcttcattttaatttgtgctatgtaagagaattttagttcctaagtttcttaatagaccaccatgggttaaaaagtttcacaactcgatccattcctataatgttttctagttcaggtgaatagtaaatagtgcaatgtataagtttagagttacagaaccatatagaagcagagatagggaagcctcaagttagttttcctccaagtccttctatgaggatgtttgtgttaaggtttgttgcattatatctaagacagcttgtgattcagtttctaaataaatgtataagtatgtgtatatttgtcaatttgtatagttaattgtatgtatggtctattatccccaggattgagtgttacagttcatacccagggggtttctcatttgttgagaaacattttcttgcaacatttttctgttgttgttgctgtttttgacattgtgagtttggccctggacctcgggaggtccattattttggaccttattttggtatctggctggtggccttagatggccctgttgccagtgttggaaataagaacttggagtcacaaagaaaacgagcactcgaacaaaggatttctcagcaaggtaaatttacttctgcagaagggtgctgcttgcacctctggccactacgagagcacactgaacaaaggagggaaggggtttttatccctaacacactccctacctctgtgtcactcccccatgggctggggtcagaccgcacaatctaagctgacttgattggctatttgtgaatattttcccaaataagggaagggaagggggatgtgagttacaggctgggactggtggttttggcgggaagaatagttgcagttgcagagtgggtaaccaagggaacaggtgtgaattattgattagaactggctggaaggttgtttactgtaactaggggcaaggaggcacaaagaatgaggaagttaggctttgaaaatagagaacaaagaacaaagaagttgaccaagctgactttttgaagaggaacttactgtacctaacaccagtttggtccttgtggccttagttgccagttattttgcctgggttgccaacttgtctgccttggtttatttttccaaggtcctccaggtctgttttgaataaacattcagacttatgtattaaatgtaaagaattttggtgccttcctgagattatctcttggtgtttttttaaatcaggtttgccataaatgttaccttgtgagttcctgataattcggcagaaagttgaaaattttctagtatactttctatggttcttcatgctgagagagaattaatgtaggagacttttaggttaggtggtgctcctgtaagtgctctttcaatttcatttgtagctggaatttcagatggaatggtatattgattatatccatcatttataattcctaagatagataattttcttgtatccttttgtgcctgtgttagatcagtccatttaagtccatcaccaaattttgttgggtttaaatattgggtagatagatatcaggctaatgtaatccagtcccagatggataggacacatgttggataatttgttgttagttctaataatttctgatttagtgatgggttttctgctaatgttttgatctgatgcatttctgtgcctgatagtgctgtggtgtttgcttcattattgcataatggaaggagtcagtctgcatctgtggtctgtctttggcaaaaatttattcttagtttttgtaattctgctgtggtgtattctctgtcctcactgatgtcctgaggtctgccatttccactgttataatctataactctttttgtagttattataggtcttgctgcatatatcccacccacctctgggatcattatattctcctaggtccactagttgggggtccttaggacccaggggttcctccttaaaagttacatctgaaagggatttacttttccttaaaattctgtgagctagctctttggctttctgaggacccctgtatatctgtgagctactttgcattaaaagtgcaggaatttcttcaaaagcctagctcttgggagcattgaaatgtaagctcagagttacattttcgaatcttgggaagaggcttgtcagacacattgtttgctttctgctgagataaggaatgtatcactctgccagagtatgactttttacagattattaaataaagttgtgtatgtctcaaaaaaagtgcagggatttcttctctgggggctctggtaattaaaggcttaacattttgtcaggtccctcaagtctgaccatacatccttgggggatcctacagggactctttctgacttccaactctgttgggtaccaaggactctcaacactaagtactgtatttgggcgatgagccctctggcatgcctgcttaattttcttaactagaacccacattatgccatattagtagctactttatatagtttcttaataatatttcaatttcccaccttaaccgactgtctgagtggaggttatgtaataattgactttcttttggccaaattaaaaatttgttttgccagtcagcatcccataaattgagacctgcttgatgtgagcattcctggctcccccagcttcctagcttggcatcaaccaagaccttgtcagccgttggatcttcacaacttgagcaagttgtcttatcacccaaggttttcctcaagtagccaggctttcaaggtgaggcgagattatgtctgctgtcagagagcatggcagtttgttttgtcaaatggcgtgatttccaatggaagttttagtgggggctttggccttaaaattgagtacaccaattatgccaagtaagccaactgtgccagttgtgcccagtaagctgactatgccagcttatcatgagaagtactggattagaaataaccaggtccatgcatgcttgtgtctttcaacaatatcaggtttttattgatgctatccaatcacaaaagccatgaactacatggagttcccaaggagacgcttccccttagttcttcctgttcacttagtagtcagagccacaggcacacaagcttaagccactccacaagtcagtcagtattgcaaaccatacataacagtatgccaaatcaatatgcaagtgttataggttaaacactccacaacaaacaaagtaaaatttaccatcaagaagaaaaagagataagataaaggattaaggaatctgtctaggtggaatgaagaagacaaaaggaatcctggtctgggccagccagtcaattggtcttgcaaggaagagtgtttgtggtggcagagcctttggcagcagatgccaagttcttatcataaatgactgcaagaaggtatcagtgaagatggctgttttgagctgctgaaggtgtaaacttttatagtcacagagtcctctggtgagaactgatttgagtgtgaaatgtgagtgggtgaggaagattagcatacaggccttaaccaagaagaaatggacaagaatcttctcagcctgataggcctgtggttgtgcgtactttaacatttgatattttctattagctgaaatttctttttgtaatagtgttgttgaactagtatagatacactgataaagatcttccatgctgataaaaaatgatcatggcatctcatgaaggaaagactaatctaagaggattatgttctggctttgcctagatgaatgatcttgtgtttcccagattttgcccatgactccctcctcatgcttattgataacagattgcacacatctatcccaacagaggttaaaatgacttctaaaacccttgagggtgtctctgtcttagagtaacctctccatgggaagagtaactttatgaagaataagtatatgttttgtgggatctatggggtgttgcttttctggccagaaacctctgcggctggtggcatctttgcccaagttcttgtcttgtgtccaggaagaaggaggtaggcagacaagtggagagtgagcaagatgaaaaagagctttattgagtgttagaacagctcagaggagacctgcagtgtgtagctcctctctgtacgtagttcctcctatcatacagtgttcagctctcagcaaagaggaggcctggagtgagtggctcctctctgcagacaggtcgtcctgatgagtgttcacctctcagcatagagggtggctcctttctgcagcttgtcatcctgttgtctgcagctctcagcagagagaaggctctgaagagggtagctcccctctgcaactggtcgtcctgaagtctgctgctctggcagaatctggggtttgtatgggcttcagggagaaagtgcatgctgattggtccatgggcagccgtgggcaggcctggtaaaaagcaccatgagttccccctccagtccgcaggaatggcagcctggatcccaggcttcaggcctttccgggcctaaaggtggcgtttcaccagggaccccccttctgcccagaagcctgtcggactcctaccaccattcatggctcccagactgtttgtgccaagggctgcctgcaggccagtgctgaacttccttccgccccccgactccatttccctcctgtgttcattggtgcccaaagcctgggggactcaggcaaaaggtgtctggcaggtcagcactaccctgagcgtgcatccacccagccgggctgtgacagtgcccaggcggccccaaccttgctccacaatcagagcgggcactgggagtagggagaggccaggcagtgggaacaggcacttctgagcgggggaacaggggccgtccagggctcccaagagcacagatatgcctaggtccaaagccgagctcggcaggctgcagctgcacctgggcagctcccgtcccaccaacttggaagaggcgaggctcctgcttgtccctggctcccacttgtccttggctcccaccagtttcatgcagtgtgcagccccggccatgcctctgagatcggagtggacgctgacagtgcggagaaaccaggcagtgggagcaggcacttccaaacctgccggggaggcacttccaaacctgccggggggcgcctttccttggccccctagagcccagagacacccagatctggagccacagtagagcagctgcagccatacagggggcagggctcctgcctgctctgtggaacaggaggccgggccgtgctgcagccagtatgatggcagctgctgctccagatgggccacccctgcccctgccatcatatggaatcatgttggagaaatgtctttagacttacttaggattagaaatatctatatattctgtatacttatattattgacatgtattaataacaaaactttttatttgcgcacacacgcgtgcgggcacacatacatacaacgctagtcccaggagccaagtgagagagaagatcagggtgcagctgagatttaaggtgctgggaaggaaaagaaggaatgtctgtggtggagagagaggaggcctatatgttcatcatgcattatgccataactagtaacaggaggaaagaaaacattaagaaaggatctcaaacatttcctgaaagttggctggaaaagtgaagagtatagtatgcagttttgtgcagtccctcactataaagaatttccctttttccttgagacttattttctgtgtttgaaaatacctttctcatcagtgttctatattagcaaatccaagaaaacaatgtttaatattagtcataaaattgtgcactatctcttagttattgcatcaaaaacataagcatcttttaataaaacgtatagcgtgccaagtcaacacacttataacacctaggataaggcctgtttacatggcgtttttaactcctttctaaatgagacaactcagactctgagatcgtgtcttactaaagagcacttgactggttgggatagattggtacttcattccctaaatagtatttttcccctctctgtttttgtaagtaaaaagtgaatggttttgcttaaaatgcttaatgatcaaatgtgtctgcactgtaaggtagctcagtactggctcaggaaaagacacagttcaatgaagagactccagaaaagagctcagtgaatgatggccattgtcctttggttgatattttttgcagtaaatttggtaaaagctggacaattcaagatactgacctataagtagttatatcactatgactttaagaggctttttaaaagttgtttaaatactttcataattagaaaaatcaaaagtatcataagattatcatgaaacagagattatttcctcaaaatatagtatttccaaactaaacatttacataatttggtccatggattattttagcaattcactgttaaggagtttccaaaacatgactgacaacaatgcccattaatttcttcccaccctacttccttattctcacttcaagacagtaaattcactgttagtcacaattaattttgctattatttctggtactttgtttcacataggattcatttatgaaatgttacttatagggcttttggacctaaatatgactttttaaaatttttaatttttgtgggtacatagtaggtgcatatatttggggggtatatagaatattttgatacaggcatacaatatgtaataatcacatcaggataaatggggtatccatcaccttaagcatttatcctttgtgttacaaacaatctggttatactcttttagttatttttaaaatgccattacattattattgactatagtcaccctgttgtaatgtcaaatactagatcctttttattctttctaacttattttatttaacataatgacctccagctccatctatgttactgcaaatgacaggatttcatttatttttatggctgaatagtattccattgtgtatatataccatattttctttatccatttgtccattgatggacacttagtttgactccatatcttggccattgtgaatactgctgcaataaacatcgacatgcaggtatctcttctatatactgatttccttccttttggatatatacccagtattcagaatgctggatcatatggtagatctattttttctattttgagtaacctccatactgttttccgtagtggaaatttgcatgcccaccagcagtgtaccagcattccccttagtctgtatcctctctagcatctgctattttgtgtctttttgataatagccattttaactgggatgagatgatatctcactgtggttttaatatgcatttctctgaagattgtgatggcagtggcagcccatctggagtggctgctgtgaaaacactggctgcaacagggaaggctcagcaatggctgtgcactccctggagctggttggtgctgggaatgggcaggagccttgctccctcaggcccctctggactttgggcactgatgagagtgggagggaggccaggggtgctgagggtggcttggtgcaggcctgcagcaccaaacagtcccctctgcacaaacagcctgggaagcattgatggcatgttgatggcagtaggaggcagacaggttcctgggcagaaaggggcaggtctgttgtgaagtcccactttcaagccatgggtggcctgaatgaagcctgcgggccaagctgcctgttctgggtggagtctgtggcctggaatgaaaacttatggagctttttctgggcctgcccatgactgcccatgaaccagtctgcacatgcttcctcccttctaagcccataaaaaccccagactcagccagactcatacagacatcaggactacctgcctgcggaaaggagctacccactatagaactcctctccactgagagctggacactcattgggacaacctgtgtgcagataggagctaccactccagatcttctctctggtgagggctgcacttgtcaggtctacctacctgcagaaaggagctacccactatgggtctcctctcttctgacagctggacacttgttgggatgacctgcctgtagaaaggagctgcccaccctgggtctccttgctgctagctagacacttgttggacttgttgggacaacctgcctgcggataggagctacccactccaggtctcctctctgctgagggctgcactcatcaggactacctgcctgtggaaagaagctacccactatgggtctcccctccactgaaagctggaaactcgttgggatgacctgcctgtagaaaggagctgcccaccctgggtctccttgctgctagctagactagacacttgttgggacaacctgcctgcggataagagctacccactccaggtctcctctctgctgagggttgcactcatcaggactacctgcctgtggaaagaagctacccactatgggtctcctctccactgaaagctggaaactcgtcaggatgacctgcttgcagaaaggagctacctactttgggtctcctgaaagctgctctgtggctcaataaaactcctctctgccttgctcaccctctagttgtctgtgtaccttgttattcctggacatgggacaagaactcaggatccacccactgaatggcaggactgaaaaagttgtaacacaaacagggctaaaacacgcccttccacttgccacattgtgggtgacaagaatgagggaagagttgtggctcttcggggagcccagacctaggtgctttccaagccagggctatgacaccctctttggggcttgcagtttctggtatctccaaacttccaggtggcactgtgttcccctcatgcagacacaggtgcctgcagcagaagccacttctggtgcatctgatccagttgcaggcttgcatggagctagcacctgtgccagtgactggcactgcctcccctgctgcagcagctggcatgcctggctgtgaacagtggccggaccctgtgttcacttgctcatgcacccctcactgctctatgcctgtcttgcccttggcaggcctggaatctggactggtagtgtgagctgaacacagcctcccaggccgaatgggcagagtgagccccagcagacccaagcaaaactcggacaaaagcgccattggccacagaggtttccatctggaaatgtgacacctgatgatcctgtgacattttgtaatattgagcattttttcatattcctgttggctgttggtgtgtcttttttttgagaaatttctattcagatctttgccatttttaattggattacttggttttgttgctattgagttgtttgagtttcttatatattctggttattaattatttgtcaggtggatagtttgcaaatattttctccaattctgtaggttgccttttcactctgttgactgtttcctttgctgtgcagaaggtttttagcttgatataatcccatttgtctatttgtgctttggttttgcttttaaggtcttaagcaaaaaatgtttgcccagaccaatgtcttgaagcattttcccagtgttttcttctagtattttcttagtttcaagtcttatattaaattctttaatccaacttgagttggcttttttatatggtaagagataggggtctagtttcatttttctgcactggaatatctagtgttccctgcaccacttattgaagaaactttcctttccccaccgaatgtttttgctgctttcatgaaaaatcacttggctttaaatatgtggatgtaaatccagattctctattctgttccactggtctgtgtgtggcatggtgttatgcaagcaccatgatgttttggttactctggctttgtggaatattttgaagtcaggtagtgtgatgtttccagcttttttctttttgcccaggatggctttggctatttggggtcttctttggttccatatgaattttaggatgtttttttcatttctgtgaagaatgtaattgacatttcaataaaaattgccttgaactgtagatcacttttggtagtttggtcactgataatcttttcatttttaaggaactgacctggaagccaatcttgaggaactgtctcaaatgatgaatggaggtaaacatggatatggtactgatataaagggggagtttgtgtcaaatatagagcctgcttgagtgccaggagcaggcacattgttcattaagatgcaaaattatgtgaatttgttttctacaagattatatataataatatactgataatgacactgctacttcgataacagagttcaattacaaatggtctttgaaaggtaattctgatcccaaatgcctggttacctgactaatacactgtcatatacagaaacaaattggatcaaagccatattgagtcataaaatatgcaaccattttcttacctttgagtataacagttaacaattttcagattcttttcttatttctacttttaacaaacacagaatgcatttgtaataccagtttgtgtgaaatatgctgagccctgaaggagattgtagtactagctctgctataatttgtgagattctggatgaatcccataaattatacacctatctttgtgctttttgaaaataatgaattcaaaccagatgttttaaaatcagtttcgatactgatttctgtattctctggttcttttggatagaatacaaagatattctgttttccatggttggtttatcataaaatatcagcttgagtcaaggtatactatctgaattgagatttgattgctcctaagaaaatgagtgtgcactctgcttaatgtttgtttttgtttatggagacctgaatgactgttcttggatcttatcaacttttgaattctctggctcttaaagaataattgctctttaagttcttcccccagtgaagcttcaaatgaccaaataatcaaatggcaagagatagtctagtttctagtttctgtcactgatgagttagggagagtgcatggaggtcagtaaggcccaaggtaggtgtaagatatctgtactaagcactctccctactctactctctgtctttatgagctactatttctaattagactatagacgtgtatatgatataatcacctctatatatcatatgttacatattacaagtttctgccttgagacatccattgataggatctgagattcaaagaccataacatagtaattcacgagtagtcaacataagtatgtgttgcatgttttccaaattgctgactgttcattacagaagattctgcatttaaaggaagcatttgatgtttagggaaaaaattaccttgcattagtcttctaaatgtttttgctctacactgctgaaccattccatcagatgacttaaattaaaagatagttttcagaccacttcaagcagccatctgaatatggctaaaatgcactcttaggaagatcatagcctttaaatgtgtatgttattaaaacagataaattacatgaacatccaatataaaaataatgatacagtagcaacagaacaaacctaaggggaaaggaaagaggtacttaataaaagacatgtatgaattattagtaaaaagaaaagtaatccaactagtaaattttaaaaagattactctttttagaaatagctatgaggtggaggcaagatggccaaataggaacagctccagtctagagctcccagcgtgagtgatgcagaagacagggatttctgcatttccaactgaggtaccgggatcatctcactggggattgtcagacagtgggtgcaggacagcgggtgcagtgcacccagcttgagccaaagcagggtgaggcatcgcctcaactgggaagcgcaaggggccagggaattccctttcctagtcaaagaaaggggtgacagacggcacctggaaaatcgggtcactcccaccctaatactgcgcttttccaatggtcgtagcaaacggcacaccaggagattatatcctgcacatggctcggagggtcctatgcccacggagcctcactcattgccagcacagcagtctgagatcaaaccacaaggcagcagtgaggctgggggaggggcaccaaccatttccgaagcttgagtaggtaaacaaagcggccaggaaggtcaaactgggtggagcccaccacagctcaaggaggcctgcctgcctctgtagactccacctctgggggcagggcatagccaaacaaaaggcagcagaatcctctgcaaacttaaatgtccctatctgacagctttgaagagagtagtggttctcccaacatgcactaggagatctgagaacggacagactgcctcctcaagtggatccctgacccccgagtagccctactgggaggcaccccccagtaggggcagactgacacctcacacggccgggtactcttctgagacaaagctcccacaggaacaatcaggcagctacatttgctgctcaccggtattcactgttctgcagcctctgctgctgatacccaggcaaacggggcctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggcgagaaaaacagagcagaaaaactggaaactctaaaaatctgagtgcctctcctcctccaaaggaacgcagctcctcaccagcaacagaacaaagctggacggagaatgactttgatgagttgagagaagaaggcttcagatgatcaaactactctgagctaaaggaggaagttcgaacccatggcaaagaagttaaaaaccttgaaaaaaaattagacgaatggctaactagaataaccaatgcagagaagtccgtaaagcagctgatggagctgaaaaccaaggctcaagaactacgtgacgaatgcacaaacctcagtagacgattcgatcaactggaagaaagggtatcagtgatggaagatcaaatgaatgaaatgaagcaagaagagaagtttagagaaaaaagaataaaaagaaacgacaaagcctccaagaaatatgggactatgtgaaaagaccaaatctatgtctgattggtgtacctgaaagtgatggggagaaaggaaccaagatggaaaacactctgcaggatattatccaggagaacttccgcaatctagcaaggcaggccaacattcaaattcaggaaatacagagaacgccacaaagatactccttgagaagagcaactccaagacacataattgtcagattcaccaaagttgaaatgcaggaaaaaaatgttaagggcagccagagagaaaggtcgggttacacacaaagggaagcccatcagactaacagctgctctctcggcagaaactctacaagccagaagagagtgggggccaatatacaacattcttaaagaaaagaattttcaacccagaatttcatatccagccaaactaagcttcataagtgaaggagaaataaaatcctttacagacaagcaaatgctgagagattttatcaccaccaggcctgccctaaaagagctcctaaaggaagcattaaacatggaaaggaacaaccagtaccagccactgcaaaaacatgccaaattataaaaaccatcgaggctaggaagaaactgcatcaactaaagagcaaaataaccagctaatatcataatgacaggatcaaattcacacataacaatataaaccttaaatgtaaatggactaaatgctccaattaaaacacacagactggcaaattggataaggagtcaagacccatcagtgtgctgtattcaggaaacccatctcacatgcagaaacacacataggctcaaaataaagggatggaggaagatctaccaagcaaatggaaaactgaaaaaggcagggctttcaatcctagtctctgataaaacacattttaaaccaacaaagatcaaaagagacaaagaaggccattacataatggtaaagggatcaattcaacaagaagagctagctatcctaaatatatatgcacacaatacaggagcacccagattcataaagcaagtacttagagacctacaaagagacttagactcccacataataataatgggagactttaacaccccactgtcaacattagacagatcaatgagacagaaagttaacaaggatatccacgaattgaactcagctctgcatcaagcagacctaatagacatctacagaactctccaccccaaatcaatagaatatacattcttctcagcaccacaccacacttattccaaaattgaccacacagttggaagtaaagcactcctcagcaaatgtaaaagaacagaaattataacaaactgtctctcagaacacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacaaagacacaacatcccagcatctctgggacacattcaaagcagtgtatagagggaaatttatagcactaaatgcccacaagagaaagcaggaaagatccaagattgacaccctaacatcacaattaaaagaactagagaagcaagagcaaacacattcaaaagctagcagaaggcaagaaataatgtaagatcagagcagaactgaaggaaatagagacacacaaaacccttcaaaaatcaatgaatccaggagctgcttttttggaaagatcaacaaaattgatagaccactagcaagactaatagaaaagagagaagaatcaaatagatgcaataaaaaatgataaaggggatatcaccaccgatcccacagaaatacaaactacgatgaaagaatactatatacacatctatgcaaataaactagaaaatctagaagaaatggataaattcctggacacatacaccctcccaagacgaaaccaggaagaagttgaatctctgaatagaccaataacaggctctgaaattgtggcaataattaacggcttaccaaccaaaaaaagtccaggaccagatggattcacagctgaattcttccagaggtacaaagaggagctggtaccattccttctgaaactattccaatcaatagaaaaagagggaatcttctctaactcattttttgaggccagcatcaacctgataccaaagcctggcagagacacaacaaaaaaaagagaattttagaccaatatccctgatgaacattgatgcaaaaattctcaataaaatactggcaaaccgaatccagcagcacatcaaaaagcttatccacaatgatcaagtgggcttcatccctgggatgcaagggtggttcaacatacacaaatcaataaatgtaatccagcatataaacagaaccaaacacaaaaaccatatgattatctcaatagatgcagaaaaggcctttgacaaaattcaacagcccttcatgctaaaaactctcaataaattaggtattgatgggacgtatcttaaaataataagagctatctatgacaaacccacagccaatatcatactgaatgggcaaaaactggaagcattccctttgaaaattggcaaaagacagggatgccctctctcaccactcctattcaacatagtgttggaagttctggccagggcaatcaggcaggagaaagaaataaaaggtattcaattaggaaaagaggaagtcaaattgtccctgtttgcagatgatatgattgtatatctagaaaaccccatcatctcagcccaaaatctccttaaactgataagcaactttagcaaagtctcaggatagaaaatcaatgtgcaaaaatcacaagcattcctatacaccaataacagacaaacagagagccaaatcatgagtgaactcccattcacaattgcttcaaagagaatcaaatacctaggaatccaacttacaagggacgtgaagaacctcttcaaggagaactacaaaccactgctcaatgaagtaaaagaggatataaacaaatggaagaacattccatgctcatgggtaggaagaatcaatatcatgaaaatggccatactgtcaaaggtaatttatagattcaatgccatccccatcaagctaccaatgactttcttcacagaataggaaaaaagtactttaaagttcacgtggaactgaaaaagagcccacattgccaagtcaatcctaagccaaaagaacaaagctggaggcatcacgctacctgacttcaaactatagtacaaagctacagtaaccaaaacagcatggtactggtaccaaaacagagatatagatcaagggaacagaacagagccctcagaaataatgccgcgtatctacaactatctgatctttgacaaacctgacaaaaacaagaaatggggaaaggattccctgtttaataaatggtactgggaaaactggctagccatatgtagaaagctgaaactggatcccttccttacaccttgtacaaaaattaattcaagatggattaaagacttacatgttagatctgaaaccataaaaaccctagaagaaaacctaggcaataccattcaggccataggcatgtgcaaggagttcatgtctaaaacaccaaaagcaatggcaacaaaagccaaaattgacaaatgggatctaattaaactaaagagcttctgcacagcaaaagaaactatcatcagagtgaacaggcaccctacagaatgggagaaaatttttgcaatctactcatctgacaaagggctaatatccagaatctacaatgaactccatcaaatttacaagaaaaaaacaaacaaccccatcaaaaagtgggcaaaggatatgaacagacacttctcaaaagaagacatttatgcaaccaaaacacacatgaaaaaatgctcatcatcactggccatcagagaaatgcaaatcaaaaccacaatgagataccatctcacaccagttagaatggctatcattaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattctggcactattcacaatagcaaagacttggaaccaacccaaatgtccatcgatgatagactggattaagaaaatgtagcacatatccaccatggaatactatgcagccataaaaaggatgagttcatgtcctttgtagggacatggatgaagctggaaaccatcattctcagcaaactcttgcaaggacaaaaagccaaacaccacatgttctcactcataggtgggaattgaacaattggaacacatggacccaggtaggggtccatcacacaccagggccttttgtggggtgggggcaggggggagggatagcattaggagatatacctaatgctaaatgacgagttaatgggtgcagcacaccgacatggcacatgtatacatatgtaactaacctgcacgttgtgcacatgtaccctaaaacttaaagtataataataataataaacaaataaatagataaataaaaataaaaaataaaagacctattacaatttctggcaaaaaaaaatagctatgagtagagtattaagtcatttacataatcttgaaaaaagtggaaaaaactcaacatggaatatgaacaagatgctgacagatattgaatatatggtataatccaaagtgaatacattcttgaactctaatattttcaaaatatggatgaaatggttgatatgctaggaaagcatatagtctttaacatatcccagtaatacctgaatatctaagcatcacaagtaccatggaagaacttctgaaatttgtcagttgttcttcaaaaatactgacttttagaaacaaatacttggcttttgcaggtatcgtactctctctatccatttccctctccctctctccattcattcattcatttaatttgtttatttttctttttttttctttttcttttcgttttttttttggccgtactgtgagatatggtatatatctccacattttttttatgttgaaaatgatggtagtaaccatatgatgtattatattaactggaatgctttcaagtgtgaaaagaagcactcctcgtaattgcaacaggactataggtgaaaactcgggacaaatggttatcctactttaacaactccaaaagggttatactagcccagagaaatatttttgcacttctgcaaaatagagaaaagaagaaatgcagtgctgacctttctgtgttttttcacttatataattccaaatgtaacattaaccagttttggttttctgttccaaaatggccaaataggaacagctccagtttgcagctcccagcgagattgaaccagaagatgggtgatttctgcatttccaactgaggtacctggttcatctcattgggactggttgaacagtgggtgcagctcatggagggccagctgaagtagggcggggtgtcgcctcacccaggaagcacaaggggtcgggggatttccctttcatagccaaggaaagccatgacatactgtacctggaaaaacgggatactcctgcccagatactgcacttttcccatggtcttagcaaccggcagaccaggagattctctcctgtgcctggctcagtgagtcccacgcccatggagccttgctcactgctagtgcagcagtctgaggtgaaactgtgaggctgcagcctggctgggggagggacgtctgccattgctgaggcttgagtaggtaaacaaagtggccaggaagctcaaactgggcagagccgaccgcagctcagcaaggcctactgcctctatagactccacctctgtgggcagggcatagctgaacaaaaggcagtagaaacttctgcagagttaaatgtccctgacagctctgaagagagcagtggttctcccagcatggcatttgagctctgagaacacacagactgcctcctcaagtgggcccctgacctctgtgtagcctaactgggagacacctcccagtagggactgacagacacctcatgcagttgggtgcccctctgggatgaagcttccagaggaaggatcaggcagcaatatttgctgttcttcagcctctgctggtgatacccagacaaacagcatctgtagcggacctccagcaaactccaacagacctgtagctgagggacctgtctgttggaaggaaaactaacaaacagaaaggaatagcatcaacatcaacaaaaaggacatctacaccaaaaccccatctgtaggtcaccaacatcaaagaccaaaggtagataaaaccacaaagacggggagaaaccagagcagaaaagctgaatgttctaaaaaccagagtgcctcttctcctccaaaggatcgcagctccttgctagcaatggaacaaagctggacggagaataactttgatgagttgacagaagtaggcttcagaaggtcggtactaacaaacttctccgagctaaaggagcatgttctaacccattgcaaggaagctaaaaaccttgaaaaaaggttagacgaatggctagctagacatcttctactgtgctacagaaaaatataactagaatacactaaagccatttggaacagtttgtgaggactcggaaaaaacaactgatatcagaatcttcacatggaaaaatgacacatctgcaaatatgtctgacctttctttaaaaattatgaggtggagaaggagaagcaccaaacctctttttccatctacgtaattccatcagcctgaaagtcaccacatctcattcagaagctcctgcagctgcctgattgcagcctgatatccctcttactagagataatatatgagttacaactctgagctctgttcatatcatcaccctccaaaagataattctgctgcaaagggccctactcagaatctgcactgcttagggaggggaaggggattataatcagcaattatttctcccttttacagaaattttaaaatgttttctgatccaaaaggactgaaaagctagggttcaaataaaaagtaagactaaatgtaggggatcctatttgccacaaaatatgtgagaagtccctaggctatggagctggatgaaagaattagggcctaggtagaagaaaggggaaagcaaccagggcaacttgctaaagcgaaatgacttgggtcctacctacactgtctccttataggctatggcatgaaatacccatgggattccatcctgcctcttacacactgaccttgagatggtgggaaagttacactcatttggtctgtttccctaattttaaagtagaaattagaatatttacactaaatgattactatgaagaataaatgagataacatttgaagtaggaactactttgcagatggatttggtttattccatttttctttttttaaaagttttaattgacatataattgtacatatttatggggtacaccaagcttgtttaacttgtggcctgagggccacatgcaccccaggacagctctgaatgcagcccaacacaaattcgtaaactttcttaaaacattatgagattttttttgtgatttttttttagctcatcagctattgttagtgttcatatattttatgtgtggcccaagacaattctccttcctccttctagctatttgaaactatatgttattgttaactatagttatcctacagtggtataggacactagaacttattcctcttatctagctgttattttatatcctttaacaaatctctcctatctttcccttccctctacccttcacatcctttagttttctttatttttttcatttaaattttcagatgagatcagtaaggtggtaagaccgtagacttcatttacattttgaaaaatttttatgtcatttactttcacagttagatctctaataggtcatactgcttttgaattttgagtaggaatatgaggttaccttttttaaatgaatttgagttcataaactttaaataaatcatttaatagcaatgtagctggtgtaggacatggcatctattctaataaccgaagtctggcaaagtctgccctaagtcatgatatgtgctgagaacttcttgttctgtgtgatgtcaagggaaataaaatattctggctgccaagtgatcagtcagtttctaagcagcattgcagtggctaacagggccacaaggatcactactgcaattgtcaggttggcttgtcacacttccatagattcggccagtaagaaaataattgagcccagatggatccaaacagtatattacagacacagcaaaagcaagatcagcattgtgtcagctccctggttccctggttccacagtttgacactgaatcaaaggtgctcggtgacagcatagatagtaggttgctcttccagtgtcaaaggtgctcggtgacagcatagatagtaggttgctcttccagtgaggagcccacagctataccgtaaggtggtaagcagttttatatctcacagctgtaccttaaaatggggcaaggaggaatgtcctgtgcttatgattaatgactttgtgtcagcttctagcaaaatagggaggcaggtggaaaagttccttgtggcagctcctcactaggttgcttattcccccttgccccaagaggaaccactgcatgtttgacaagattctagtcagagtacagttaatccttgctgatgtggcctgtgtgacatgcaaggtcaccagggcaccaaggcaaagccactcttctacatctggcacaaagtgaaaagctgtatgtatggtacctgcaaacataatatctacaataatgactcctaaatggaggagatgcttttactgccaagatcattacaacagcatgttcaggaaatatctgggatactagaaatgaaaagaccaaagatgtacagtgtttgccatgggggtcatatcacactatggtggagcagacagacatataaacagaaaaggaatttaagtacaaagtagaaaaaaatggatgagactcagcaggaaaattaaaactccgtgagcagggtatccaagaatctggatatagaatagttatataagatatagaatagttatatcactcccccaaatttcctccttccttttttattcaaccactccaccaagctccagtccctggagaccaccaatctgttctctatccctttagctttgccttttgcagaatgttatataaatcaagttataaaatgcataaccttttgggtcttttttctctttgcataatacatttcagattcacctatgctattgcacatatcagtatttcattccttttattgctgagtcgtatttccttgtatggatataatacagtatgtttatccattcatcagttgaaatatttgaaactgttttcagttttgggctactatgaataaggccatcataaatgtccatctgcaggtcctgtgtgaacataacttttcatttgtcttgcatgaatatctaggagtggaattgctggttcatatagtaagtatatgtttaacttcataagaaattgccaaactgttttccaaagtgggtgtatcattttgcatccctaccagcaatgtgagagttccagttgcactgtatcctaactagcaattaatattgtcagagttctttttaaatttttcttctcattttagcttttagaataggtaattgtgattttgatttgcatttccttcatgatttatgatatcaatatcttttcctgtgcttacttgccatccatatatcttctttggtgaagtgttcaaatctttggttcatttcaattgggttgtttattattattgatatttgagtattctttatatactctgaaagcaagtagtttatcagatatgtgttttgcacatattttcttcttctatgtggcttgtcttgtttttctcttaattttgtctttttaatgttgaactccaaagattttaatgttgaagttcaatgtatcagtatttttcatatagatggtgtttttggtgtcttatgtaacaaatctttgcctaactttattaattttctagggttgtcataacaaattaccataaaattggtggcttaaagcaacagaaatgtattctctatacttccagacaccaaaggtccaaaatcaaggtgttagcaaggttggttccttttggaggctctgagggagaatatgttccatttctctctcctagcttctggtggaaattcttgctccaatttctgcctccattttcagatagtgttttgtgtttctctgtgttctattcttttattataagagcaccactcattggatttagggcccatcttaatctagcgtgacctcatcttaacataactaattacttctacaaagatcctatttccaaataaggtcacattctgaggattcaggtgaacacgaatttatactaactaaaggccacaagtatcttatatattttgttctagaagttttgttacttttggtgacaactttcactccatgttccaaattaggttcactgttgtatgtggtatggattataagtaaaggttcatttcttgttcttgtgaaatccaataccccaaaagtatatgttgaaaagattgtctttccccattgcctttacacctttgttgaaaatcatttgattaaatgagtctattgctagactctagtcactgatttttttttgtcaatactacattctttttttttttttttttttaagagatgggagtcctactctgtcacccaggctggagtgcagtggcatgatcatagctcattgcagcctcgaattcctgggctcaagcgatactcctgcttcagtttcctaagtagctgggactacatgcaggcaccaccacgcctggcgaattgcacatcctcttgattactgtaggattatagttgagtcttaaaatcaggtagagtgaattcttcatcattggccttcttcagaattgtttttggtattttagttcctttgcctttcaatacaattttgagaatcagctttattgaagtaggttgaagacagaatggtctaagcacagtgaagcagtttttgctttgaagggaaacaaataaatgtgttagtagctgcaggaggacatgtgagaaggggatgaggtttttcctccttagcttggggaatgatccaatatagagggggccattgatggttcaggagccggagtgatcattgcaggagcaaagctcctgtgaaggtgggaggcatgggatcctgagctgaggtgagggcactggcttcagttaggagcattgtatgcagaagggcggcagagaatgccagatcaggcatgggtagactaggtttgggaagctctgagaattcccagcagatttcttctgtcctctcaatgaattattagaggaagccattcaaatggagaagagattctagcattatcggggagtattgtagtggtggaggtaggatgagagtgaaagtgaaaagctatgctcttatggtcatggatttaaggtaaaataatttagaaggttttctattttattattattatactttaagttttagggtacatgtgcacaatgtgcaggtttgttacatatgtatacgtgtgccatgttggtgtgctgcacccattaactcgtcatttagcattaggtgtatctcctaatgctatccctcccccctccccccaccccacaacagtccccggagtgtgatgttccccttcctgtgtccttgtgttctcgttgtttaattcccacctgtgagtgagaacatgcggtgtttggttttttgtccttgtgacagtttgctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccgcaataaacatgcgtgtgcatgtgtctttatagcagtatgatttatagtcctttgggtgtatacccagtaatgggatggctgggtcaaatggtatttctagttctagatctttgaggaattgccacactgacttccacaatggttgagctagtttccagtcccatcaacagtgtgaaagtgttcctatttctccacatcctctccagcacctgttgtttcctgactttttaatgattgccattctaaatggtgtgagatggtatctcattgtggttttgatttgcatttctctgatggccagtgatgaagagcattttttcatgtgtgttttggctgcataaatgtcttcttttgagaagtgtctgttcatatccttcgcccacttttttatgggaatttagaaggttttaaggttttctcatcactgctcagttgctcagatacaggcatcattatatggtcattatattagtaggaggaagaggagtgctagcacacaaaatagatatgataatacctcctgaagaccactaaaagcatttctatttgtttgttaaggctgccatcaaaaactaccaccgactgggtggcttaaacaacagaaatgtattttctcacaattctagaggcgaaaagtctgagatcaaggtgttgacagaattcgtttcttctaaggcctctctccttgccttgtagatggctgtcttctccctgtgtcttaatcatagttttccccacatacatgtctgtgtcccaatttcttcttgtacggacaccaggcatattgcattatgacccactctaattaccccatttgacttaattacctcttcaaagacagtcacattctgaggtactaggggttaagacttcaaatgtgaattttgagcatacacaactcatccaaacaacagtattattttattattagttttactcctattgttactataatttatttcatttttaaaattaccctgcaaggtaggaggtagtcactaaagctcaggagctatatctcttgctgaacctcaccaggaatgaaagtactagtcaaacagacaaaactcatgtgttttgtagtatatgtagctgagatagaaagtcaacctagttgttatcatgaattcatttgttatcattaaattataaatattcagcatcggtaaagaaaataatgaaaaataatcagtctcatcaaatctacaagtataatggaagtcatactgaatttagagtccaatgagatgcgcttggtcaggcaactgcaggaaaatgctgccaagtgtcctcacccctgcatcctcgaggcaggtgattaataggggaatcctgagaccactgcaaacattctcacattcacacctgttcaaacctacacatctgtaacgatttatgaagggaacaaaaaaatggctctacttcccaagttttaggagtggggatatcattagcaacacctgagaaattgtggcacaccactgcttgtacagggtccttggacatttaggtgtcaagatttggtcaccagaaacactagagaatgtatcagaatttgatctatgtcctttgtgacagaagctttctaaatgatgaggttcacgtgtatttgctgttctatggatccccttgaataagtatattgcactggacatttttaagaggcacatattattttcaagttttttgacttggggaataaaccatctgtaaaatttacacagaaattcaatggactacaaacagccaagctgaagaagaacacaggtgaagaacttacagtacgaaaatcaacactcattataaaatacgagtaattaatacagtgatgtattgacactaggatagtaaaaataaaccagtggaacagaatagactcaagaaatagttccagtcatagaaaatcacctgacttactacaaaggagccattgcaactaagggaagaaagaatgattcttgatcactggataccacatggaaattaaatcttgggcctttggtcatatcggccacaaaaatcaattcctgatggatcttttgaccaaaattggtcaaaatatgaaagttaaaacaagctagaagtagcataggaaaatattcttatgacttcagaataggcatagtttaaaaaaaaacaggacatgatgagcactaagaataaaagatcgacaatatataattgattaaaattaagatcatctgttcatctccaaggcaccactgagaagatgaaaaaactagccattgaatgggaatatgttagttctaatacatatatccaaaaaaggactcatggagaatatctaaggaacttccacaaatgaccaagaaaaaggcagacaatctagtaagaataggcaaaaggcttggaaagccatttcacaaaaaaacaataaccaagtagaaaataaatatgaatatgtgctcaataagtgttcaaaatctttagtcatcagggaaatacaattaaaaccacaataagatactactacatgctcactataaaggttaaattgagagagagggagagggagaaaaatccactgttgacagggatctgaagcaactgcagctggagggcactcccacactgcttctggaacatagtttgtttcaaccacttttgccatctgttttcttgtaacacttaaagctaagcatggtactggtaccaaaacagagatatagaccaatggaacagagcagagccctcagaaataataccacacatctacaaccatctgatctttgacaaacctgacaaaaactagaaatggggaaaggattccctattgaataaatggtgccgggaaaacgggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagcctaaattgacaaatgcgatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaacttacaagaaaaaaataaacaatgccatcaacaagtgggcaaaggatatgaacagacacttctcaaaagaagacatttatgcagccaatagacacatgaaaaaatgctcatcatcactggccatcagagaaatgcaaatcaaaaccacaatgagataccatctcacacctgttagaatggcgataatgaaaaagtcaggaaacaacaggtgctggagaggatgtggagaaataggaacacttttacactgttggtgggactgtaaactagttcagccattgtggaagacagtgtggcaattcctcaaagatctagaactagaaataccatttgatccagccgtcccattactgggtatgtacgcaaaggattataaatcatgctgctataaaacatgcacacgtatgtttattgcgacactattcacaatagcaaagacttggaaccaagccaaatgtccaacaatgatagactggattaagaaaatgtggcacatatccaccatggaatactatgcagccataaaaaaggatgagttcatgtcctttgtagggacatggatgaagttggaaaccatcattctcagcaaactgtcacaaggacaaaaaaccaaacaccacatgttctcactcataggtgggaattgaacaatgaaaacacatggacataggaaggggaacatcacacaccggggcctgttgtgaggtgggggaaggggggagggatagcattaggagatatacctaatgtaaatgacgagttaatgggtgcagcacaccaacatggcacacgtatacatacgtaactaacctgcacattgtgcacatataccctagaacttaaagtaaaagaaaaaagagaaaaaaaaagaacaaaaaaagctaagcatttaaagctgcatcccctattacagcaatgccactccttagcttatacagcccaagtcttcacttaatgtagttggataggttcttggaaatttcgactttatgcaaaaatgtacagtaggtccccaaataacgtcatttccttcaacatcattttgttatagcatttataagaaaaaaatggttttgttatatgttgcttcacttacagtcacagtttccaagaacctgttcatgacattaagttactgtacctaacgggtatgtgcccataggtttacatgaaacatgtacaggaatattaatagcattgattaataacatcaaaaatgggaaataatccaaatgtccatcaactttagaatgagtaataaaattgttgagtattcaagcaatgaattattagacagaaatgaaaaatcttaaactacttctatgtgtaacaggatagatgaatttcacaaacataagaaagaatgaaagaagccaggcatgaaaagcttacatatagtgctattccattcacagaatgttacaaaaaaacaagcaaaactattcttttaagttggattaatgattgggaaaggattgctatggaggcttctttggtgatgtaaatggagcacaggggatatttaagattgtgaaactcctctgtatgatactgtaatggtagatacattatgcatttattaaaactcatagaactgtacaacacaaatagtgaactctaatgtaaattatggaccttggtcaataataatgtcaatgttggtttattaattgtagtaaatgtactaaattaataataggggaaattgaggggaagggcttaagggaactatctgtgcttcctatgcaatttttctgtaaacctaaaacttctctaaaaatacagtctattaatttttaaaaagtcaaaatagtgataatttttgctggattaatgattgggaaaggattatgatgggagcttcggtggtgctggtaatgctgtatattatgttgtgaatattggtgatgtgcatggttcattgtgtaaaattcatccagttgtattactaaaatttaggggtgtatgtaatgaaaaaaaacataccctccaaaaaaagaagtcccagaaaaaccaaactgaactttagaagctaaaggccttgttagaacactcctgtagtttgagaaatctataaacacaacagctgattgctaaaattagttctgagataaatagcctgaaataaattgtaaaaagaagccatttttcttccaaacttgattcttcagaatatgatacccatttctgagtccatggttgtaatgactctactatattgcttagtaagggtgtatctgtccaaaacatgttcattgtacagatgttacttgaggcttttactgtgggacaggaaatacaggcactttcctgaccccagactttgaaggcaaaatatacagtcgtatgtgatttgtcatcttcatctcagaaacctgtgaactttgtggagcttcttgctgaccatggaaagcctatcacctgtctttggggattgccctgtggtgccaggtctttaaagcacaccatcagctaccaagtaaattattttctcccccagactgatgatgtgtttggaagaagggaaggatatcctaccatcctctgtcactttggggaaagctgcaaggttgattaagtgaactagtggccatattatatggagctccaactatgtagcaggcacttccctttgtgcccccacatcctgttcccattatcttctcaaccttgcagtgtaactcttatgatgccttttgaaaatagttatgaaagttaagacacagattagatttttaccaagttaaagaacactattcacactcttccatgtcatgtgttacattgcaatgttaaacattaatttttcatttgtttctcagaatcaatattcacaccatgatatagaacattaccagcaccacagaagctcccatcataatcctttcccaaccattaacccagcacaattttccactatttttacttttaaaaaattaatggagctaggtccacattgcaatattttgatgaataacaatatgaaaatagctgtcattgctcttagatggtaagtgcaatttggctgttcattgatggaatcagctatcatcttgagcttgtgtttcatactagatgctgggtacctagaaaccttaatcctcattattgttgttaatctaaaccttaattgagcacatgtgttccaggcactgagttatgtgctaccccagtaaaagtccagaccatttcaggcacatagataatatttttctcactttacatagaagaagctgagggaatgagacattgacttgccacaaattgaatgcaaattctaggttttccaggttctgtctatatgatgttgtgttggtggcttacccttttatgaacttcaatttcctcatctataaattgggattagttacaatatgcactgcctctgtttttggtgggttcaatagaatacactgcctcagtgtctgggtggagtagatgaaatcgcatatgaggtacttagcccagttgtttgcaaagagtaaatgctcaacacatcataataattttggtcaatactattactactattactactatagaaaattccagactgtgatctatcactggagaaagacatagtgcaatctgtggaagatgtttataaggactaatttgccaactcttgtcacaacgattttctttaagaaggatcttgaaagtataccactagtcaatcccccttttcttggggtatgtcattaaaagctaaataagataataaaaaattgcaagtttaaagcaggctgaaggccttcttacagaagtggtggagatgctaggcaatgatggcttcttgtcttatcccttattttccatagctgctgccaaaaatcatgttctctggacaagatctttatatttcatattatatatattttttaagacactgagatgatgcccaagatgagcattacttgtttttttggtgttgtgtaagtttttttgaatgcagatacatgcagttatttacaagataacactggaataaagaaagtaaagttcctgaagttgaaaacacttggtttaccattatctccattcccccacaataaccctggcagtacataaaagaatccatgttttataggactgaggctcagagatgttaagtgacttgtcctcaatcacagtgtggtctccctgaatccaaaagcatccctggctgctctgacacatggtcatgacccaagccagccttttctcgtatctgcagcttatcagaagattttaggacagaagataattctataaagtgaccatatactgatcttagctgccatctcactctttgtagggacacagcttcttcctgtgggccactcatttacatagtttgcttcagattctatgatttggggagctatggcctggaacatgattatgtgaggtttaagaactctgtatatgtactgggtcagtcctgtggttgctctagggtcttattctagggaaccacactgctctgccattgtaaaatttctactctagaatccaggaattcctcaaaactttttctttggggcacaaacaaccagaggtaacatcctaatctctgccattttcagtgtgtgtgacctgtggcaagacatttactcactctgaaacaattttcttatctgtcatgtgaggtaactgcctttcagattggctctgaagatttcatggaataacacatgtaaattatctgacacagtagagggagagtgccagagaccactagttctcttacttcatcctcttactgcccattctattccttggcttcagttaccagcccattatactttagaccaaatatctgcttaaatcacccctgcctcaagtttccttcatctagctactcagcttctgaaaacagaggaaagatttctgtgaacccagagggaaatttcttggtcacagtttcagtcgggaaggaaatttccttattatatggattcccacaatttaccatatcttttggttagatcctaagaacatttcatggttgcccaccataagcctggccctgtaacctctctttttttcccatgtttcctgctgatcaacaggtcagtctcagctccttccctccacagcaacctctaggtcctccatgcttcagcccctcctctgccctttgcacgaggaggacaatttccatttctccctaaggttcctgtccgaattcttacttccaaaaaacagctctgtaactaagagccctcttcaggatgctcactccttcatagtccttaggaaagtgtacacaattgttttatgctctcaaaatatttaaaaattatcttccctccattctagtaggcctcagcatcagatgtataggcaacgggccagaggatctgcagaatgttctctaggatgagaagttgctgaaagtgttaagagcagatggtctgagaaccaaggagagctagatcagtgagaaaaggaggaaggaaccaggggaatcaactgggaataataaagttggggactgcctgcagtgcactctacgtgggctttagtatcagatagacttgggttagagtcctggtcctcccatactagctgtctgaccctgagaaagttaactaacttctctgggtctctgtattctagtctgtgatgatagaccataaagtgcataaaattatgcaacatttttcttcggaaatttttaaatttttcttattttcgtttttaattctggcaaaatacacataacaaaatttaccatcttaaccattttaaagtgtacggttcagtagtgttacatacatttacattgttgtacgaccaatttccagaactctttttatcctgcataacaaacccattaaacctatactcatcaaaaaacaacttcccattgcttcctcctcccaggctctgagagccgctactctaccttctgtccctatgaatttgtaaaaatcataaaattctactattacttattgttttgttctatttgggatgctataacaaaataccataaactgggtggtttataaacaacggaaatgtatttctcacagttctggatgctggaaagttgaagatttggtgtttgatgagggctcactggttcacagatgacacctcactgtgtcctcacatggtagaaggggaaaatgtgctccctgagtcttactttatgaaggcacacctttttggggaggtgattaggtcacaagggcaaagccctcatgcatgagatttcataatctaatcacctccccaaagtccccatatgctaatgctatcaccctggggattaggatttcaacatataaatttggagagagagacagaaacattcagaccacagcacttatatccaatctgagccttattttttttaaatgttattatataattttgattttgctgtacttaattttaattagatttttgttgttctttgggagtttgttgtttttattgtttctttttgccaagtgacatttttatttaagtaaagttatcaagtcacaggtagaaagcagagaaagtagtaactctgaaggtagtacttaatgattgaagttgggaattaattaaatgattaattcaacattcagtggtatgtagtaagatttgggaagtgtcctgaatgatcagcttccaaagaccagggtccttgtcctagaggggctcacagctctgtggcagagacagacccattcatctaatctacatgaatttattaagtgcctatgacatgccagacaatgttctgaatatttaagatacagcagttcacaaaacagacaaagattcctgtcctacaaaagcttatattacctcaggggtggtgatggttgaaatataatttatggttcatttgatacagtcatgtgcccggtctctgccaatagtgttcgggaataaggataccctcttaactccctctcatgtactataatttaattctccaccctgcggatgccaagcagaagcattgggattgaagaggcatgatctgatgtggtcctgatgcagtaccacatggcacccatgatgtagcatggcaacacagccttgtaattgtgagagatagatccatgatgtcagtgcgtactgggggatttataactgtggagggccatggtgactgtgatctcttatccccatcccagccaatcaccagcctcaccacaagctatcctgaaagtctcttgattcatttaaattgtttttcagagtggtgagtaaagttttatcatgctctgctattaagcactacagatttcactttatagtttctcagtattttattctaagaaatttcccactagttctcttgattttctgggcaaataatcacaccgatacacaaaaatcatgtcttttcaaacagcgagcacctctgtttacttcacatagatttcaacgtgagatttatattgccagatttttttcttactgttttctagatgtcttctgctcaatatttgcttttaacgttgtttcattttaagagaaaagcaatttaacaaaatatgctggcaaaaattgtatataaagtatgattttaatgttgtaaactatgcatatatatgcccactcccacacatacagaaaaatgactggacagagatatgccaaaatgttaatagtgtttgtctctaggttatttccttttgtgtgcctttgaaattgtatgccaccctaaatagtctacctttataacaaaaaatggccataaaatgacatttaagattatctaagcaaaattttatatgatacaataaataccatttggcagaaaattaaatattcatgtattatctcttagactgcatactgcatatatcaataatgtaaaaatatatttctaattatctttaaataagccaaaattagatcttgctccattcggagaatttatagtgaaactccatgatattctattgagtaaagttaatgggtgcagcacaccaacatggcacatgtatacatatgtaacaaacctgcacgttgtgcacatgtaccctaaaacttaaaatgtaataaaaaaactttgtcatttcacttgtgaattcttaagcagctttagcctccctttgttgaacagggaacctggccactaattcatatctacctgtgagtcccatcctaatatttgagtttcagctgtaatactgcttttctcacaattgtcaatattttcctgtaattgtgtgaaagaaagttcacaggctgagatgctaaatcagtgctttgtcatttatcggctacattaactttggtccagttactctcctttgctgatcctcagtttcctcagataaagagacctaataattcttattcgaatttctcatgatcaacacatggcgaatggaaataataatcattgtcattactcttgatagtcatttaatagaatggaatgatcagattgcagtggaattgcattcatatttagtggggtaatatatcagttattattaacagacaactgaacatgggatgactgggaatttgaagcacttaaaaagtaaacttgaggcttgatgaggtggcatggagtaagctacaaaggactccagctcccacttcctgcctcatctccatgctgggtgtggaccaggtggcacctgctcaatcaagaatgactgctagggttctagtctaggcaactaggtagacggtggtgaccacatccaagcaactccttcctcagtgattcagcaacttgcactgttctgtgattgactatctcctctcctctccagtttcattcaaccaggaaatcagcaataataaaggctgtaattccctcagcacccactctgtgccagacacttcattcattccagatataaacattaattgagggccatctgtgtgccaggcagtgtcctaggagctggggattctccagtgcactaagcggtcttaaatgcctgcctttgttcagtttatattcttgtgggggagacagtcataaataataaatttaaataagtcaacaaataatgcagtgcagtagttggcaattcatgctacaggaaaagtagagcaggaaagggggattgggagtgctggttggtgggtatgccattttaaatgggatgttcatggtccgcctcattgagaagatgacatgtgagcagatacttgaagactgtgaagagtaagggaacagtggtatctagaggaacaatgctgtaggcaccgagtacagctcatgcacacaaagaggagtttgtatgctctgagttccaagcacactgagctgggcacttgtgtcacaattttaaaatcacagtctaggggacgtgggaaggatagagaattgcacaagcaattacaagaaacgtgtaagcactacctatgtcagaatgaagagtactttgtcagcatttggcttttgggcaagtcagatgagctcccctgaggaagtgccacgaatctcagaactaaaaggataggaggagttagccaggatgtggagaagagttttctaaacaagatgcaaaggtatgaccttccattaggaagtgcagcttagaattctgcctacagggaatgtaattgtcagagggcaccagctgctacattctaaaatgcatctccatgtttttactagaccacgaatcttgcaggctgctctttgcctgtgactgagtgtagcagagacactaaggtaggactgttcccaaggggcaagggactcttgtgatggctgactttattgtctgttcattccatctgccctttgttcccttttcccttattctgctttttttttttttgtttatttttgtggattcattttatttcctttgtaagcttattggcaataactttgttatttcagtgtttgctcttgggtttaaaatatacttttaacctgtcattgtatacatttaagtaatattatataacttaatttatactattagaatgttacagtatactccatctctttcctcccaatctttgtgttacttttcatacattttacttttacatatgtgaaaatccctacactacattgttttttcatgaacaaatatctttcaaagagtttaaatagtaatgaaatcatataccttaacccatacagttaatatttccagtgctcttcattcgtttgtctagatccatattttcatctggtgtcattttcctcctgcttgaaggacttcctttaatattacttgtaatgcagttctgctggtgatgaattctctgattttgtatgtctgaaaaagactttattttgccactgttcttaaaagttatttgtactgtgtatagaattctaggctgacagggatttttttttcactcagtactttaagatatccctgtatgtcttcacttgcattgttcagaaaagaaatttcctctttgtaattaacgtgtcttgtttatctggctggttttaggacttttctctgtatcactggttttgagctattttattatcatgtgctttggtataattttctttgctgggtgcggtggctcacacctgtaatcccagcactttgggaggccaaggtgggcggatcacctgaggccaggagtttgagaccagcctgaccaacatggagaaaccccatctctactaaaaaatacgaaattagccgggtgtggtggcacatgcctgtaatcccagctactcgggaggctgaggcaggagaattgcttgaacccaggaggtggagcttgtggtgagccgagatggcatgccattgcactccagcctgggcaacaagagcgaaactccgtctcaaaaaaaaaaaaaaaaaaagaaaaagaaaaaaagaaattttcttcatgttacttgtgctcaggcttgttgagcttcttgtacctgtgcatttatagttctcataaaatgtggaaaaaaatttggccattttttcttcaaatattttctctgtcctcaccccttgctctactacttcaggaactccaattgcaaatgtatgagaccacctgaagttgtcctctggctcactgatactctgttagtttctttaaattattgtcttttcttggtggtttcattttggatcatttgtattgctgtcatcaagtttggtattttttttctgcgatatctaatataccattaatctcatccagtgtatttttaatctttcacattgccgtttttatctataggtcatttgtgtcttgttgatatttttcacgactcaacttaattttttgaacatacggaatacaggtatagtaactgttttaatatcctaatatgctatttctaatgtttgggtcagtttcaattgattgacttatcttctaattatgggttgaattttaatgactattttcatgcctgctaggttttatagcctgactggtgggaacagatgctattcccatttctgcaagagcactgggtattatcccctctaatcctgtgagatggttcttttctaggcctcaggaagttacctcacagtgaggtgctgagggagaccctattaagaccttatagattttatatttaaatcttgatgcatattcctagcttgccttccagtgtcaccaggagtatatagaagtaaccattatccttcatattctccaatattatttatgtgtttgctctttcattcattcatttacttacttatatttcatgtgaattgttaggcaggactgaaatagtgctcagtctagggctaagttacaccacactactgagaaaaaagatccttatgagtactctaccgaatgtcttatgaatcttgaggttttctagtgtgactggtgagaacaggcactatttccagtcctgtacctgtgctagctactcttctctctaatcctatgagatggttctttccctggcctcaggaagttacctaacatgcatgttcagaacagtaatctgctgaatacctgagagagactcttttaagatccctggggttctctccctttgcaactttctcttctctggtactctctgagctccaattgtcttgatctcctcagacactcagctcagggagtccattgggctccacctggtttccctctacatgtgcagaagcctgaaagctctctcaaggcaataagttgaggcaatctttggtcccaccttttttgtttcctttctctccaggatcactgtcctttgctgcctgatgtacagtgactttccagtcgttgttttatctatcttgtctgtttttttatgggggtgggggagggttgtttcaggtgggaggttaaatctggttactgttactccattttgtctagaaacaagttgatgaccaactttggctcaaggattccccaacgacctttccaaactctacttagaactggtgtgcaatctaaaatgctttcatcccacctgattccttatttctctctcttcctcactcaagttcagacctgagggacccaagttcagacccagctccccctagtctgccattcactctcacccaataaatgtattatttgtttcccctcataaattttgtgcaggttgaatcctacttcagtatcagcttctcaaaggcttggactaacacaaaaagcatgtgtgagatactttgactccaaaacaacacattggagtcttatgttctttgtgatcttaacacctactctaacggaggccaagttttatttactggatgtagcctgaatatttcaagacatacttagaatgtaaaatgtatataactccatgcatggaagtagcctatttattgcagttaaacccttacgggtgtatatttgtttccacttttccacagtttcaaatataggtagtgtaaatacctttgtttagaaatgtttgtatatttcaaacaaatggaagaacattccatgctcataggtaggaagaatcaatattgtgaaaatggccatactgcccaaggtaatttatatattcaatgccatccccatcaagctaccaatgactttcttcacagaattggaaaaaactactttaaagttcgtatggaaccaaaaaagagcctgcattgccaagtcaatcctaagccaaaagaacaaagctggaggcatcacgctacctgacttcaaactatactacaaggctacagtaaccaaaacagcatggtactggtactaaaacagaaatatagaccaatagaacagaacagagccctcagaaataatgccacatatctacaactatctgatctttgacaaacctgagaaaaacaagaaatggggaaaggattccctatttaataaatggtgctgggaaaactggctagccatatgtagaaagctgaaactggatcccttccttacaccttatacaaaaattaattcaagttggatgaaagacttaaatgttagacctaaaaccataaaaaccctagaagaaaacctaggcaataccattcaggacataggcatgggcaaggagttcatgtctaaaacaccaaaagcaatggcaacaaaagccaaaattgacaaatgcgatctaattaaactaaagagcttctgcacagcaaaagaaactaccatcagagtgaacaggcaacctacagaatgggagaaaatttttgcaatctactcatctgacaaagggctaatatccagaatctacaatgaactccatcaaatttacaagaaaaaaacaaacaacaccatcaaaaagtgggcaaagtatatgaacagacacttctcaaaagaaaacatttatgcaggcaacagacatgaaaaaatgcttatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgagactgtaaactagttcaaccattgtggaagttggtgtggtgattcctcagggatctagaactagaaataccatttgacccagccatcccattactgggtatataggcaaaggattataaatcatcctgctataaagacacatgtacatgtatgtttattgcggcactattcacaatagcaaagacttggaaccaacccaaatgtccaacaatgatagactggattaagaaaatgtggcacatatccaccatggaatgctatgcagccataaaaaaggatgagttcatgtcctttgtagggacatagatgaaactggaaaccatcattctcagcaaactatcacaaagacaaaaaaaccaaacaccacatgttctcactcataggtgggaattgaacaatgagaacacatgaacacaggaaggggaacataacacaccggggcctgttgtggagtgggggaaggggggagggatagcattaggagatatacctaatgttaaatgacgagttaatgggtgcagcacaccaacatggcacatgtatacatatgtaacaaacccgcatgttgtgcacatgtaccctaaaacttaaagtataataataaaaaatacaataaaaaaagactttagaggatttgaacaactcaaaaaaagagaaacttttgtatatctgtccaatcatttcatgaaaagttttttataagtaatatgtctggatcgtatagattttacactgaaattgtgatgcaatgcatattcttagcctggattccaatctcgccagaagtgtatgaaggtaactgatatcccttatcctctccaacattatttgattatttgcttaattagttttagtatcttttccaggggtaggattaaaaaggaagtaaagcaagtctcaacctttatatgacaatcttgctctggataataattttctcttgttaaataaaagaactataactgaagctttctttctcttcagtctttatatcatgatatatcactaaatcaaacatgcctttgtcctgatcctccagaacaagccagtaaaatgttctgattttttgtacctgttccctaagaaaggcctcatggcacagatatgaagagttctggctttggggataggaagatctgaagcagaatttccagctccatcacttactaactgttttttaggcaagttactgtagctctgggtgcctcagttttgctgtacacatctgaggggtaagaggagtgagagacatagacaaattttgagccctggtcagagacttgaacatggctcctatgacttcatccattctgtgaagatgagaccacaagacccatccctactgcccctgctctcttcagtatgggaaatggaaggatacagacagcctagttacaggctaggaggtaccattaaccacgggcctgcataagtcacacatcagtgaggagatgaagggtgccaggacccctgaaaatctcatttagcttagcagcactcagtggtgttctggacccagatcatatcaagtcacaaaagctgatctctaaataccccaggaatttttcaaaccatttatgaaattgtcaacaacttgaaatctgcgatgatggaagtatttacaccacagacattagctagcaaatgctacacatcagtgtcatccttccacaccccattacctcaccagtacttttctttttgtttatactttcaatgtacatgcttcactttatccttagttaagttgtactaagaagaggtaaaataatatgctgcaaagttatggagctaatcctcatagcttattttgtagtcatccgtaccaacagtggagtcccagcttttcaatgaacattgtaggaacaggcacaaccctgagtgggtttaacaaatctattgaggagccaaaggggatggatgaggcttgtcaaattctctgagatggtccccagggtcagcagacaactgatccatatctccctggtgatgagaaaggaccagaaatgaaccccttgacagagctagggtaacttagttaagatacattttttatatagcagaaaacatgactaaataggtttaatctatgatgaaaaattatctcatataacaaaaagtccataagtatgatggtttcaggcatgattaatttcatagttctatgacactgtaaagtaacaaactctgtatttttgggcttctgtccttactggataggcttctcctcagccaggatctcctcgtgttaccaaaattgtggctacaattccaggcaccatattcagacacaatgacattcagtggaaaacaagggcctgacacttgctatgtggattctattatgagcaaggaaacctcctgaaatgccagaaattagattgcacttccagtcagctcattctgaacctgaataaaatattgttctatttgtggaatttattacgaattcccatgttccacccagtaaaaatataaagattattagctacgctcttccatccagatttaacctttgttggatgagtaggaatttttgatgtgtggtttcatacttgattattaccccttactaatgtctgatatttaactatcactctagatacataaaatagtatcctaaattatgttaggtcctgggattcaaggggggaaaagatacatatgacccctgccctcaaggaactcctactctgttaggaaagattccataaaataagcactgacaagaaactgtgataagtgctttgtattaaggagaaggcaattgtatggattttgtctgcacatgacaggaaataatctaacttcaagaaggcagacaaagcctcctagagaaatataagtgtaacttgaaagatggagattaagtagcaattagccagatggagagggaaagcatcctacacagagggaacaacatgggtgaggttatgaaaatcagagagaaaatgggccatctgatgaacagaaagttgttcagattggctggaacatagcatgtaggatactgtttcatgatactgcctgaaatatagtaggcttctttgaatatatattgggttaattaatctttttaatgaccctgattggaaaaacatccccttaagtcttggatgagtactgaagggttatttgtgtaggcaccagtctgtaacaattcctcagtctttccagcatgccacattatatttagatgtcatgtcgcctcagtcttctagaatcagccatttatcccagaagccctggttctttttattagagaatggtataaagaaaccaagacctgggtgtcaggtgtgctcattgcagctaatggtataaaattcacaagatacagcataataattagaaaactagtagacctttggcttccatgctttcaggaggggagcaagcctggaccaaggaagccactttaatatgactttcactgtatgttcaattattaacatgcttcactgttgttggtataatttctatttggggtagaaagatgttttctaccataaaaaaatacaaagcgtttttgtgaccctccctgttctttcttttacctccaccacttttttttgcagtttaacaacttttggctgcggtcttttcctcactaatttcaagtaatttgagaacgtcaagcttcaatttcctgtccagccctgaagatccaataagagcttcaagctgggactgtaacttcatggatccaccacagagagtcactccaactttgaattctgattcatctctgattccaaccaaagaaatgccccagaaagttacatcaacctcccaaacatccttccctgaaatgcaaaacctgggcccaattaacttcaaccatggtccttgtagcaactacgtcaaccctcagccagaggggctgctccaactgcagtatgaagatgagatgacccaacaagagaggcaatgggaaaggtcagcattccctgagaagaaaaagatattcatggagaacataagacagaaaatcctcaatcccatggcaccttactgggctgaagggaaagtaaaaatctcttcctcatatgataaagataaaaataaatgtaaatatctttactgccagatctatagggaggataattctaggagccctagtgggtagaatccatcctcttggaaaacgctagtgcagggccttaaccacttgaccttcagccctggtaccatacagacctgtcatctaccagaggagctgctcaagagaagtaaagagagaagagccatcatgagagccagaagaaaggcaaaagagcctaggctcctaaaatgacagtcgaaataaatccaagactctaatcctcgtgattagatcagaattgattcagatgtgtgaatattgattttagccagttgcttgggtggaaatttttgggaactatacaattaggaatggtcattagaagcagcaagaaccagtattttgacaaaaaaaaattgtatcagtatgagatttgatctagttctaggaaagcaacgatcattttcccagtaattttagagttaatctgggaaatactgggatgatctactctgcggcaaggaagatgggtaaacaatggttctttttattattattattatactttaagttctagggcacatgtgcacaatgtgcaggtttgttacataggtatacatgtgccatgttggtttgctgcacccatcaactcatcatttacattaggtatttctcctaatgctatccctcccccagaccccaccccccgacaggccccagtgtgtgatgttccccgctctgtgtccaagtgttctcataaacaatgcttcttaacttattatttagtttttatgataggacctgtctttcttctccttagatctctttttccccatcctgtttccagtaaggtataaaggatatgtgtagtgtaaatgtcttgctggttttgaaatgtttttgttcagtctcatggattgaccaaaaggaaaaaaaaagcaaaaacacaatgtctgatgaaatttatttgtgttttggaattctgaggttaataaaaagatgagatccacttttaaagttttgaatcaaaagaatgtgtgacaaaaggatgtgtgaatagaatttgtgggcttcacattgaattgtttggataaactacttttcatgaggcacgtataggaaaaaattttttttttgaaacggagtttcactcttgttgcccaggctggagtgcagtggcacgatctcggctcactgtaacctctgcctcccgagttcaagagattgtcctgcctcagtctcccgagtagctgggattacaggcacctgccaccatgcccagctaattttagcattttttagtagagacggggtttcaccatgttggccaagctggtcttgaactcatgagctcaggttatccaccattacaaagtgctgggattacaggcatgagccactgcacccccggccaggaaaatatttttatgctcctttataattgttaaacacctccctgaagaaatttccaatgtgttgtctcaattgtcaacaacaatacctgtgtatttttatttaatattacttggatggtagtttgtcaaggggaactacttgcagattagaatagggatgtaggaaagggacctttgaaaacatttgcattactctttatggtaccataatcagggcagcatgtgaagtagccattggatggtccaactcccgctttgtgatagcagtgggaagcagtaccctgcccaccatgtaagcatatgcgtgttgtgcagctgccacggatttaggtgttccacaatagattcttccctctcaggtgccccagcactctcatgcttgctattggcgcgggggcccagagcattattatgttgtttttacttctgccagttgtgtgaccaacagtatatatgcgttttcttttcataatatgaaattgattgtgctaatttctttcctatagagccctctgagagttatcccaccacaggtcataatattctgctgatgggaaaataagtttggctctggggaaatctgctttcttaggcaatcttcagtggtgcaatagagcaaaaactccataatgttttcacacataaacacttgaggacatacaaattaatatggactggatcctaggcttgtgatttcatcagagtatgagagttaaagtaatcctgtattgtttataccacaattcaagaggacagtgtaaaaaattgcatattttatacatttgaaaggtcatggcctaatttcattatgtaaaatgtgatatgttttcagagaaatataatagttttcttatgactctggcaatattccaaatacatataggtgcatgtacatttaaagatacaaccagcttggaactgattaaaatcaaggcaggtttttgggggagaaaacattgacaaacaatacaaccttattcttcaagattgagtttgctattctaggttctttgcatttatatataagttttagaagaagtatggctggatgtcttaaaatattagggtcccccagagaaacagaacaaatgtgcatatatatatatatacacacacacacactcatatatgtatatatacacacactatctatctatacacacacacacacaaacatatagaaagagagaaaagacaaaggaagacttttatttttaaggaattggctcacatgattgtagaggctaccaagtccaaaatctgtggcatccaaaatctgcgggataggctggtactctggagactcagggaagagtttatattgcagatcaagcttgaagacagtctgggggcaaaattctctcttcctcaggggactccagcctatttactcccaaggtcttcaactgattggatgaggcctgcattacggagagtagtatgcttttctcaatatctactgatttaaacattaatctgatctaaaaaaatagtgtcccagcaacacctagattggtatttgatcaaatatctagataccatggcttagccaacttgacacgtaaaattaagtattacaagtccaccttttgtcaatttggcacccaaatacatatctttaaaccattcctaatctccaagtaaatataataatgaggttgtgcttccacctaacaagatacaagtatcctatgtaaaaccaaaagcgcactaaccctttccccagataaggatgcacttgggtgatgttgactcttctccatgatatcctgtaacttaaatactacaatgtaaagtcaataaatctcatatgataaggggataaaagatagaaaaaaagctatttgtttaacgtgtatataggcacaacctccatccctgtgcatatacacacatacatttcatgacaaaataaagaagaaatactcaattgtagtccttgtttgtaaaactggtcacatgatcatacctggtatttataactaccttcttccactatccattccttaagtcctttcgccctctgcaagcacttcagctaattgtatttcttacctggtggggtgacccaaaccttcattcctaaattctcccggccattagtagtcctacctgcattactgggttgttgttgtgtcccattgatcttaatcacaaggcatggtaatattaagagacaccctaagaaatctcctattttctggacattctgttccttacctccattgtggaggagcagtccagtttcccccttggtagtcaggatcaatcacctcggccagcacagaaactcccttatttgcttgttgattcagagacatgaggaaaccaaaatggctagttggcaattttaacttccagttcaatggaatcattgtggtgtctcctggtagaaacattcctccctttggaactaagacctctaggccagcatagcataaagacatagaaacgagaagcaaaaagtttgctagtggatcactaggagtaatagtgagtagtgtcactctcatttccatcccttgattcctggacttgtgaatcctggctatgggagaaacaacaccacatgctggacactgattcagagcatatacagccttgtggagaactttgccacagccttgcaagtattgccacctagctggcactgtaactgagtctttaaaagggcattccacagtcttaccaagccagctacttcaggatggtcaggaacatggtaagaccaataaattttaagagcatgggccctttgccactgctgtaaattgagttccttgatcagaagcaatgtcatatggaatagcacaatggtggattaagcattctgtaaattcatagatggtagttttgacagagcattacctgcagggaaggtaaatccttgttcagagtgtctaatacaataagaacaaaacattacactttccatgatggaagcagtcgaatctaatcaacctgctaccaggtagctggatgatcaccctagagaatggtgctatatcctggactgaatgttggtctctgctgcttgtaggttgggcactcagcagtggccgtggccaggttgaccttggtgagtggaagtccatgttgctgagcccgtgcataacctgcatccctgcaaccatgggcactttactcataggcacattgagcaatgatggggtggctgcggaaggaggctgagtggtgtccatagaacagataatcttatccccttgattattaaaatcctcctctgctgaggtcaccctttggtgagcattcacatgagaagcaaatattttcacatttttcacctattcagagaggtctatccacatacctcttccccatacttccttgtcaccaattttccaatcatattttttccaagcgcctgaccactcagctaaaccattgtccacagcccatcaactggtacctagtcacatgtccagccatttctctttctaagcaaaataagcaaccaggtgcactgcttgaagttctgcccactgggaagatttcccttcaccactgcccttcagagatgtctcagaaagggacgataattctgcagctcttcactttcaggtggttcctgcatatcatgcagaaccatccgtaaagcagggccaagttttctcttcctctgtcaaccgcctgtgccactggtctgcacagatccacgaagagacttgtttccagatcaaagctgaaagagaaaagagtaaaagaaaagttataattcaacctgtaccagtcacttttccatgggttcactctctggtataaggcatctgcttctgcttacttttcagattcctcaggtaagtgtttttgtttttgattttgtttttttgttttgttttgtttatgttttgttttgtttttttggtgtttttttttttcatttggtctagaatctttagttataatcagtgggagagataggcagtactatgccaactccatggtggccaaaagtggaactcctgattgggttgcttttatagactttagtttttagagcagttttaggtccacagtaaaattgaacagaagacacagagattttccatatgcctctgccccgacacatgcatagccttcccaattatcaatatccctcaccagaatagtgcatttgttacaattgatgaacctacattgatatatcactatcatccaaagcccatagtgtacattagggttcactcttggtgtcatgcattatatgggtttggacaaatgtataatgacatgtttccaccattatagtatcacatacagtagtctcgttgccctaaataattcctctgtgcgttgtgtatttattcctgcctccctccaacccctagcaaccaccaatccttttactatcttcatagttttgccttttccagaatgtcacgtcgttggaatcacacagtatgtggtcttttcagattggctttttttcacttagtaatatgcatttaaggttcatctgtgtcttttcatgtcctgatagcttgtttctttttggctctgaataataaataattgtctgggtgtaccacagtgtacccattcacctacagaaagacatattgattgcttccatgctttggcaattattaataaagctgctttatacatccatgtgcaagtttttgtgtggacataagttttaactcattcaggtaaatagcaaggagtgtgattgctggatcatatggtaagagtatgtttagtcttgtgaaaaaaacaaaacaaaacaaaacctgccaaactgctttccaacattgctataccattttgcattcccatcaacaataaatgggagttcttattgctccacacccacatcttcctcagtatttaatgttgtacatgttttggattttggccattctatgtaaaagtatattattgttgttttaacttacaacctcctagtgatgttaagtatcttttcatatacttatttgccatttgtattacttctttgtgaggtgtctcttcaggtttttgcccatttattattgggttgttcatttttatattgttgaattttaagagttctgtgtgtgtatatatatatatatatagagagagagagagagagagagagagatggagttttgctcttgttgcccaggctgggcatacatatatatatatatatatatatatatatatgtatgtatgtataattaattttaattaagtttaattaattaaagtcttaattttaattaagttcagttgatcaattctttctttcatagatcatgtctttggtgttatatctaaaaagtcatcaccatacccaatgtcatatagattttctcctatgttttcttcagggcgttttatagtttttatagtttttcattttacatttatgtctatgatatattttgagttaatttttgtgtctggattctttttttttcatatgtcaatgtagagtctttcaccaccatttgttgagaagactatcttttctccactatattgcctttgctcctttgtcaaagatcagttgactatatttatatgagtctatttctgggctctatattctgttctattgctctacttatctattctttcaccagtaccatgccatgttgattactgtagctttatagtaagtcttgaagtagaatagtgtcagttctccaattttgttcttctccttcaatattgatttggatattcatggtgttttgtttctccatataaactttagaatcagttttttggtatccacaaaataacctgttgggattttcattacgattgtgttgaatctatacattaagtttggaagaactaacatcttgacaatatagacccttcctatccataaacataaagtatctctttatttatttcttctgtgatttattctatcagatatttgtactttttcccatatagatcttgtacatatttggttagatttataccactttcacctgtttattgctggtatataggacagtgattaaattttgtatattaaccttgtatcctgcaaccttgttacttattaatagttccaggatggtttattgtctattgtttttcgaattttctacatagacagtcatgtaatctgcaaacatagacagttttatttcttcctccccactctgtataccttttatttcattttcttgtcttattgcattagcttgtacttccaatatgatgttgaaaatgagtggtgagaggggacttgcttgctttttttcctgatattagcaggaaagcttctagtgtctcaccattaagaataatgtaagctgtagggtttctacagatgttctttatcaagctgaagaagttcccctctgtttctagctgtattagagttttaatcataagtagatgttggattttgtctacactttttctgcatctattgatatgatcttgtgatttttctttagcctgtttcctcactgtattttatggagtgtacaattgaattggaagttataacaagttggtggtctgagtgcaatagattctgcttggagttataagtcactcaaatgatgattttattgaaaattaatgtgttattaaaaagcggcagtggagggcttcactgaagaccagaaattatgagcaacaattgaaacatggaaaaaaatatataatctgctacaatactaatatctgtagatgtaatgagcatggtcatgtgactactgacactcctactcatcttaataggtacaaatccttggtcttctaaggcaccacaaaaagtaacactggaaatgaacattactgagtatttagtatgtgctgggcacactttaataccttgatttgtttaatctcccaacagtatcttgtgaggtagatgactccaaagcaaaagaccacttacttgtgctgcctgcctattttatacagatccctctgtaacattgtcattaccaagggaagaccaggggtctgaatcctagctgaatctatcatccctgcagtggttgttaccattaaaaagtctgcactgaaagatctcaggcttccctctattatgccaatcacacaaatacctttatatcagcaaagaaactctcacagacactgcacaatcttgtttaagtccatccatccatctctccatccagccatgcatgcaatcatgactctatccatctatccatccaagaaatatactttaagagcttcaataggccatactccattaaaaagcctcagcatcattctataaggcagatcaacggactctctaaagggaccttcttcctaattttaacactatggttctctgtgacctcctccgggcccgaatgccacctttaggcattgtgtgacatgtttatcaccagctcataaataaaagcttgcagttgcatgatgcttttaatgcatctatttggctgccgaatcactggaattctcctcactgaccaacatccgagcactagaaaatatacaaatgatgtaaatgccacatacccacttgagtagtgcttcttaactcaatatgcatcacacagcaggaagaataataactaaagttttgcttgaaaaagtacaatttggggatgaattctcatatgtaggttaagacttccgtgtattggaccaccatctctccatctattcattcatttcctaatatcagtgagtacatttccgtccctatttatctaggtctatcttcttttttggacctaagctactataaatgaaaagcaacatgttcaacccacctcttactctggtgttcaagagttgtcatttcagcatccgctgaactcaagagcaactacacaagataacaaaatcagaagagccagcaatgtaatattacagtttttagttttcattttatttttttaattttcatttttattttaagttctggggtacatgtacaggatgtgcaggttcgttacataggtaaacgtgtgacacggtggtttgctgcacctatcaacccatcacctaggtattaagcctatggtgattcctcactgatctagaaccagaaataccatatgacccagcaatcccattactgggtatataccaaaaggaatataaatcattctattacaaagatacatgcacgcgtatgttcactgcagcactattatgactttttaaaagaaatggggcttcatctctcaggtgagacagatttagtatagagtttactctaaataaatagttgtgcatgaggctctaactgtaatgcaaatgtcaaaatcagccttgaaagaaagggtaggtaataatttttaaaagacaaatcttgcctcttcatctttcatgatctaccatgtgcctacattcccgcctcatcccaggcgtccccaatgtacacatttgggacttatgccacagtcactgtgatcctctagggagcaatgagtgctcctgagtacacatgtgtacacgtgtctctgcatgttcaaggacccttgtgacaaacacatctattgagagtcacgattccatgtctgtgggtggcctcccttgatacatcctgtcttagtttccactcctttgtttgttattctctggagtcagatggattaggcttcagattctcaggtaaccaactatggatctgagctgagtgacccagtgccgataagaagaatgttgccaaaacaacagaatccatacccctttccagtaccgaggccctcctccctccccctgcctgcttggatctcaggtgagaatgggaatgtgatgtggctaagagtgaggggatagatatgtggtagagggttcgaggagagaggtgaaatcttggggtccccacagaagggactaggggagggaccagagatgccaagaaagcctgctcctgggcactgagaccctaggagatgactatgaaagtgcagtggttctaacatgtggttctatgaatttccccagcagtacacagagctgcgaacattttctgactctaagctccagggctcagaccatgggaaatgaggcctgtgttggcaaagggcagtggagcctggaatcactagtggagggcagctgcaagccttgaggaggccctgctcacctcagcaataactctcatcagtaactccactctgtgtgtctctcttctggtcttctctttctgtgctctgttgtcagggtcaatatatagcaggttaaaattgtcctgggttaaaggagaagaagaggcaaggatgtcccaatcccctcttccactgactgataagacagtgggcagagggggagctggaagagatggtatgcagagaccacaaattaattcgtgcttctcagaccagacgggggtctggtgcatttacttgctaaggctgatttgattttcattatgagtgcataacctctgtactggacagtaaggtgagaaaatactggagttatgtctaatctggtgtcagctgatgctatcatgtgaatggtccatttgtataaatgctcagcctgttttgctgaaaatgatcagtctctcagatttccaccccacctccctactcctttccaagacgattaatggtgtgtatggctttcgagtcttcatggtgatatgggaaggggcctatgacatcttatgttgactgcagtgtccttagttgtttatgagggaaggctcaatcttctctctcaggttctgctgacgatgctgatttgctcacccatttctctggctggtgtaacttgcatttttgtctctctcattttggtcaggatctggtgctccctggctgactcagcctcagcccacctgtgctggcatcagcagacccctctgaatcggggcctcatcctccttcccacatctgggcagggctgtccatagcacagcctcagctgcagggtcacctagcacctatctgggttatgcttgcttcatggtaacactcctggctcttgaatcagccacttccacattcccttctcagagaatgtagcgccctgcaggaacaaagatcagctccaaaaactgaaattcttgaactccagccatttctctaaccaaggatcttgctatttatttctgcagaagtaaactgagtcctaaatttcagctgggcaaaaaatctctttatttgggactcccttccacttctctgacacacctgtcacatgtaagataaggcccatagaagagagactgtgatgagagtctcttacctccatctgacactgtctccatgccttctacacccccaaggctggaacagaacactcttttattttctttatctttcatgttgacataaggattcccatagtaaatccagatcataaagggaagtctttaggatttgtactttctcttgtagaattcaaattcatttgaaatgtttgaaggaaattgactaacagataaagaaactcaaaatggaagggattaccaaatacaagtcaatacatcatcagtagcagggcaagctctctgtaaaaataaacttggagttcaaagggagttgtattagtcagggttctctagagggacaaaactaatagaatatatatatatatatatatgtgtgtatatatatatatgtgtatgtatatatatatatatgtgtatatatatatatatatatatacatacacatatatatatgagtttattaagtagtattaactcacacaatcacaaggtcccacaataggccatctgcaagctaaggagcaaggaagccagtccaagtcccaaagctgaagatcttggagtccaatgtttgacggcaggaagcatccagcatgggagaaaggcgtaggttgcgaggctgagacagtctattctctttatgtttttctgcctgctttatatcctagtcatagtggcagctgattagatggtgcccacccagattgagggtggttctgcctttcccagcccactgactcaaatgttaatctcctttggcaacaccctcacagacacacccaggatcgatattttgcatccttcaatccaatcaagttgacactcactattaaccgtcacaggagtcatcatgctttaaaaggggcttacaaggtgtggcatcagcattttcaatatgtgtgtccagagagcgtcacttaagcaagctatccccagcattgtctgataacttctgagactacttgagaatcagagacaaactatcctgaagcttgtggtgtgtttgtggagttacgggggcaagctcaggtgtatgttcatgtctgtattatttctgaaactttatggaggcctacatgaccttttcattagctaacatcttcctctttttccctcaaatttattgtatatgccatgtaaaacatcagtaaaataattttatgattaagaagaaaaacaaggcagggcaaagtattcctatggctttactatacataaccagaaatctacaggagttattgtggggaacatacgcattgcaaaatttcttgcagagttgaagagagattcttcagtcatgcctccaccctggcaaggaagcataaagtcgcaagtgattctttattaagtattaaacagatatttgtgtaatctctcgtaatagctatttggtagtcttatataagttggtaatttagcactgaaccagggagcagcagaagaccaaccaataaatgaataaataagtccagattgcgatcagtgttaggaagcaaatactttaggtgctagtctacaaactcactactttaaacaggacagtcagagaaagcttctctgagcagaaaccctaagatttataaggatactgctgtatgatgggaaaatggaagaaacaacccgggggagagtgtagaatgagaaggggaactggctaaacttcatgccgaaaggaagagcaagcaatgggcaatggctagtgagaaagagtggagtgaccaatatggttggaggtacaccaggagaggtattttcacaaatctaaaatttaaaatatagcataaaaagagagaggagagaaagcagggagggagggaggagagtaggctttgagaaggagggaggtgtcaaatgtactgaaggcatttggacatatagtataaaaggatgaggacgtgatcatagggttaggcaatatgaaggccattggtgcctttaaccaaagcatttttctgttgggaggtgagcagatagaagctgcatttaagtggtttgtgatgataatggttatagaacaagggaagacacatttgctgcttggagcatcagggaaatgtgtcattaccttggagaaatatgggataaggaacgggtttctgttttattacattttgtataaaatgtcagaaacaagagcatgtttgtagatgacagaagaatccagaataaataaagaatgtgacaattcaggaaaaagtgataattactacaaaagcctctaccttgagaaagtagagggcataggattcaggtgaagggctggcctcaagtaggatcctgtcacttcctccagtggggcagctgagattacaagtgcaggcccactgctgttgggaagtggtgagagtttctctccaattgctcctgttttctcaggggaatatcaaggaatatcatgagaagagttggtgctagtccttgtggaggttattgtaggaagaggagagagaagatacacttgtggagggtgcacatcgtttgtctacttgtttggtggcggggggggcgggggttgccaggagagtaggaggagggaaaatgaagagatgcgtttgaggagcgagagttaatagctttgagtaagctgggtaaggaaggtgaatggtaaggaatgccgttggggtcagtggacaggaggcctccttgaggctgaaggctatggatgttgggccattggaaggagggagctgttaggattggattgggtgttgcccatggtgagagtgggggatgcaagaaatggacatcgtggagcagcttggtctttcccgaggcccagggcacgaccacagatagaggagacgtaggtgggcaggagatcccctgaagattggagaggctctggtcatggcctggtcagtctagggggtgctgaggttaccaggaaggatcggcagagtgaggcccttaacaaacaactcacaaaactgtcaaaatagtttcctcaaatcggaatcatttttttttttagacggagtctcactctgtcacccaggctggagtgcagtggtgcgatcttgtctcactgcaacctccacctcccaggttcaagtgatcctcgtgtctcagcctcccaagtatctgggactacaggcatgagccaccacgccaggctaattttttgtatttttagtagggacagggtttcgccattttggccaggctggtctccaactcctgacctcaggtgatcctctcaccttggccttccaaagtgctgggattacaggcgtgaaccaccatgcccagccaagaaacctttggttgtaaggtttctggattttctggacacctatatccaggatgagaaacattgtcacatttcaaaatttaagatgggaagtgattgcagtctggacctgacctgccaatctgatcagtgtccaaagatgcagtaagaaattggtctgatgtgattaacaatgaatttgtccacaccagcctcctgtgaacctagcttccttcttgtctatgaacatagtgtttatgtgaccttcagtctctcccctacagttgcagtcaccccatcctcctgtaaattatacagcctcctttgatgccacttgtggatatctcactgaggagtatttacttcatgacttctgaaaccaaccacagagtgagtcataattaatcacagaatgagagtactgcccatcttgttctcaaatattggagtctatctcccctcagaccaaatcaacactcattattatagtgtccaggacactatgagttttgaagcctggcagacatgcagacatattttcaaagcctagggaaactgtcttctcaagactcaatagaaatcataatcaataaaatgattccaataccctccttggagagaatctatgcatcttagtgatgtgtttaaagtgtctggctcccaatcaccctttaagaaggatttcgtgagctatgttctaggtgtagaggatacaacaggtaacaaaaccgaaagagactctgacacaatagaagttatcagtaaatacatagcatatcacagggcagcaagtgctaggtagaaagttaagacaggagctgggcgcggtggctcatgcctgtaatcccaacactttgggaggccgaggctggtggatcgcctgaggtcaggagttcgagaccagcctgccaatatggtgaaactccatctctactaaaaatacaaaagattggctgggcatggtggtgggcgcttgtaatcccagctgccagggaggctgaggcaggagaactacttgaaccctggaggcgggggttgcagcgtgtcgagattgcgccattgcactcaagccttggtgacaaaagcgaaactccatcttagaaaaaaaaaagttaagacagggtcaggtaaatgggtaaatgggcaggatgttgttattttattcaggatgtgtggggaaggcatccctgaagaggtgatgactgagcagagacctggaggcagtgaggagcaggccttgcaattacctgagggaagagcattccaggcagaaggaacagcaagtgcaacagccctggagcaggggaagcacctggtgggtccgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgaccttctgttgcaccacaggagacatagggcttgagcccacagctggggggaaggtgccatccacactgaaagtcagccagccagccagtagaaattattaatgataatatgggaaccatggccagcatgacatttctacttccaatgggaaggcaggactttaggaatgagaaaggaactgggatggaagagagaggcagaaaggggaaggtgggggacagtgaggaaaaacacactgattgagaagggaccctggggacttctgggatgatgatcaaccttgaactatgtggttgttacatgaatgtacagcttataaaacatagacttatgtttcatacactctcgggcacagacacacacaaaaaccctcataagtgaagcagagtgcagtgggaagtgggagtagcgtgagtgtccttgactcctgcacacaggctcgcagcgccccggcctcctggtgtggaccacgcagtgtaggcagcctccttcctgcagaacctcccctgggctccaggtcttgccttctatcctggaggctccagaggctccctcaggcctgtttgtggagattgtctggtgggaaatcctctatcctgtgctcctgatgccagccatggagcaggaacaccacctctcaggggatggacaggacctgcccattttgtcctcagatgttgggatccatctcccctcaggcctcatttacacccacaatagcccaggacacgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgctgggcacagggcaaggctgagtacaggcccactgtcatctccctggctggaataggttctagcaataatgacatggatgtgtttagggggccactattctgcctaccacataccctcttccttggcaagccttgatggtaactgtcattgtccccatactggggccacagaggtagacagatggaccttagcctccaagagagtgagtgcccaccctgtagaggagaacagcatgtcgcaggcagttcacagagtgatgccttttatatcactattgtgatggttagttttaggtgtctgcttgacggggttaagaaaaacccaaatagctggcaaaccattatctctgggtgtgtctgtgagggtgtttctggcctttgaatctgtgaactgatggaggaagatcggcgtgggtgggcattgtccgatccctcgagggcacaggtacaacaagaaggcggaggaaaggggaatttgttgtcttctggagttgggacaccccgtcttctcctgcctttggacataagaactccaggttttcaagccttcagactccacgagttatgcctctggctcttctggttctcgggcctttagactcagactgaatcacaccatccaccttcttggctctccagcttgtagacggagatggcgggacctctcagcctccacagtcatgtgagccaattcccataacaagtctcctcttatatatctatagctaggtatcctattggttctatttctctggagaactctgactaatacaaccatccatacgaatactatcagcattcacctcaccatgattctgtaccagacactggctgaccacctaacatgaatcatgcttttctcacccaactccgcgactgtcaactctacttctatcacccattcacaggtgagggccttctgtattctcatcagccccatctctgagcacagtcctttgcagaggttttcccagttctcctcttccttctcctcctccttgtgaccagggctagcatcttttttctttttttcttttttttttttttgagacagtctcactctgttgcccactctggaatgtagtggtgtgatctcagttcaaacctgcacctcctgggttcaagcgattctcctgcctcagtctcctgagtagctgagattacagacacatgccaccacacctggctaatttttgtatttttagtagagagagggttttgccatgatggccaggctggtcttgaactcctgacctcaagtggtccacctcccttggcttcccaaagtgctgggattacaggcatgagctaccacgcttggccagagctagcatcttagtctcacagtggcccctgctctctaggtcctcagcccttagccctgctgtcacccacccacatcctacaacccctccactccctcttctccgtgtctgttgtccagggtgagaccaagtccaaacctgagcttcctgctaagtcaaagtgaccttttcctttcagtcagggaagcctgactgaagcctgtggtcccacggtgaggtcttggtgtctctaggcacagtgcatccatgttgcagtgatacccacctttgccagcagggggcatctcatctccaagactggaaaaacctcagagaagacagaggaacagtcttaaacattcactcctggccaggctcaggcctgtaatcctaacactttgggaggctgaggtgggtggattacaaggtcagaagatcgagatcaccctggccaacactgtgaaacctcgtctctactaaaaatacaaaaaaaaaaaaaaagtagccagtcgtggtggcctttaatcccagctactcaggaggctgaggcaggagaatcacttgaacccaggaggtggaggttgcagtgagctgagatcacaccactgcactccagcctgggtgacagagtgagactctgtttcaaaacaaacaaacaaacaaaaacattcatgactggtggggtcacaggcctcagggtgcatgaactccaggctgggtgtcccttggagcctccctctctgcatgtggacaggtaggggcagccaagggccaggttttagtgctgttcggggtcatctgcagatggcttttcactccttcctactccctttccttgtaccagaagctcatttccatggctaaaggaaaattctcatataattttatcttccttttcttatttaatgattgcatcatatgctttcttctacaagatgcactggctcagaggcctgtgcccagggcagatcaggctataggttggctagtcctgagggcaccggcctgaatcctgaaggcactggggacaggccccaacagagcctggggctcaggaaaaggccaccaacctcctagccagatcctggccaactgccagctctgcctccacccagtcatctcccagggcctgaactctgggtctagaagctccaggactggtggtctgggggagatacgggctggaaggatccctcggaagaggaggcagcagacaatctctgtacagcttgagagggtgcacagctatagggtgaggcccggcccacccagcacagatccactgacctgctgtgcagctgcaggcccagctgcttccctctaccgacctcagtctcctcacctgtgcaatgggcatcattcagccccaacatgcaggggatgctcgtgaatggaagggagctgaggcattgagaaagcagatttgccccaagagaaggaagagtgggtcaaggttggtggggaaggatggatgaggccacctcggggaaagccaggggctgccttcctggaagtgctcagggcagtcaggtggggcaatttctgaggcagtgagcaagaactgtgggctggggaccaggtgaggttgtctctatagtgttctggggtggccagccgctgtgtcactgtttcttcctgtttgtcctcacccctgcccatggggagcctagagatgagcccagtgagctcactgtgagtcactgtgacccacatgcagtcattagagccatgcatcatcatcacaacagccaccaggttaacacttgggtaatttatccaaataatgactcacctgttctgacctgatttggatgatatgccatcatttagtgtagccatagtttattcagtcattctcctattggatcgttaattagtgtttgatttactttttgaccatccagacctgtaatgagaattcttgtacatgcagtgatgttcatagagtaaccctacttgtaatagctaaaaactggaaacaacccaattacacaccaataagaagtcacataaataaattctgccagattcacactatgaattactgcacagctatgagaaggaatgagctagaccatgcagagacataacattaggtgaaagaagtcaaatacaaaagaggacacgctatgtgattccctttctacatggctcaaaagcaaataacaatagtgtttaggcatacatatgcctatattataacaattttacagacagcaaggattctaatttgcctggtgggcaaattttcttaatttttgaaattatacagtaaaatggacacttgaggtatagttctacgaatctgaacgcatgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtgtctttgagtttaattcaagttgttgaatatatcaatagttctttttttcagaataatattctattgtatgagtgtagcagattttctttatccattcacccattgaaggacatttgggttatttctaatttggtgtaattgtgaacatttgtgccataaacgtttgtgcatgaatttttgtgtgaacataaattttcattcttctatgataaatatcccagatgtccaatctttacaacaccatttgttgaaaagaccatcccctttcttttgaattgcctacaaaaataagatcaattgatttttctttttttacaaaggtgcttttatttttgggctatgtatgaaactgtcaagattgttctagtattataatactttttaaattttgttctttttcaaagttattttgatggttctagttcctttgcctttcctcataaattttagaatcagttagtctgtatctaaaaaaaaatttctgctgggaatttgattggaattgcattaaatctatacatcaatttggggacatcatgcctacattgagtctaccaatctatgagtacagtatgtccctctctttatttagttcttcttttaattctttcattcacttctgatggttttcagcatatgactcctgcacatgttttgtcagattttgaggagcagctattgtaaatcttattgtgtattttttaaaatgtttgttcctggaacttcattactagtctatagaagtgctttgatttctttgttgaacgtgtatcctgcaatgttgcttaactcccttgttcattctagaaatattttttatgaattcagcaagatttccaacaagataatcataacatctgtgagttggagtagttgtagaccctcctttccaatctgtacaccattcatttccttttcttgcctttttaaactggttggaacttctagtacaatactgaatagcaggggtgagagttagcaaccttgcttggttcctgatgttatggagaaagcagttagtctttattaagtataatgtaaggtgtaggatttgcttttagttgctccatatcaagttaagcaagctccttctactcctggtttgctaagtgtttgatactgttgtctgtaatcataaatggctgttgaattttgtcaaaggctttttctgcatcaaagtttgaccatgtggttgggattggggttttttatttttattttttcggcatgttagtatgctgaattgcattgattatttttggaatattgaaccagctttgtattctcaggacaaaccccacttggttgtggtgcattattctttttatatattattggattcaatattaacaaaatatttgtttgctaatattttgttgagaattttctgcatctatgttcataggagagattagattatattttttaagctatctttgtctgattttggtgtcagaataatgctgatcttttaagatgatttggtaaatattccaactgtcaattccatcttttaataggtatacatctattcagattatgtttatttttgagtgagctttggcagtttgtgtctttcaaggaattgttccattgtcatctaagctgctgaatgtatatgtgtagagttattcatagcatccttttcatttttgtgtggcctctaacttgtattaaacttttcaaagaacaaatgcaatcttggctcactgcagcctcaacctcctgggctctagtgatcctcttgcctcagcctcctgagcaactgggactacagacacactatcatgcccagctaacttttgtaccttttgtagagatggggtttcatcatgttgcccaggctggtttcatactcctgagctcaagcgatccgcttgccttggcctttcaaagtgctgggattacaggcatgagccaccgtacccggcctggtgcttccattcctgaagtctggcatcttagcacatgctaatcagagggtacctacatgaccagcatcaagtaaaagtcttggacactgactctctaataagctgccctggtagaaaatatgtcacgtcacacatgtcacaattcattgctgggggaacgaattctgtgactctcctagaaaagaactcctagaaacttgggctgctttcctcaggccattggtccatacaccttttctttgctaagcttgctgtatactttcattgtaataaatcttcatcaccatgagtccagctatatgctgactgtgagtcctgtgagtcctcccagcaaataataaaaaatgggagtggtcttggggacccctgacacagttgtcacaatggttggatttgccagaataagcctgactcactaaaatatggtgaaagccttgtttgagtaaagaaagactgaaggagtagggggtgatgaaggtgctcaggtgattatggccttatgcatactgtgaaacagtagctagcttttgtctcttgtgagaggtaaatgttacttatagattttaaaaagaacacatccaactctgggagacctgaatcactgcattccttggcgtctttcgccatgctggagatggggggtgggaacacagccaggtgaagattttggtgtttttcctttcctccaaatagaagaaaggggctgggaatgcacaaaagtaattttagggtggcgaaaaatgttaaaaatttgggcttctctctcctccaagtggaagggaaaaatattaaatcagttccctgcgctggagcaaagcttagataaaccaagtagagggaaaaggaaaaaatcctccagtcttttcttcagctttgctgctgctactgcagcccctcccagccttccagaaagaatctctcctggcagctatgatgttaaccttataattgcaatgagagccaaaaaaaaaaaggaattaaaagtggctttttaatttatggctgttacatccagatatataataaaagtgatgtgaaatgttatatacttataatgtcataaatgctagagggaccatccccttcagggaaagctggacaggaaaaagattttaatgggatacaacttttttgctttttgactcaggtgaggatattggaatttaaagtcaaatttagctttgaatgttacaaagaaaacgaatctccataataggatttttgctctgatgattgcctttggaacaaggaaggcaacatgaaaagataggcaatgtccaggtggaggtgcacttttagagtttttgaagtggttttcaattgttaatgaactctaatgaaatcagatatctgacccttagagagtgaagatttgtcagccagatgtgcacatttttgagtgggtccattaaattctaaggctgacaagaaaattgggcttaggataattttgcttgttacttcagcttggaacaaggctgtctggttttcagcttcttctttttgctgctgccaaagaaaagtctctttgttttgttttgttttttcatatgctgaattcatagatcctaatggcctggacctcactgtaagctgaaattgatattgtctgctatgggctatttcagcctcagtaggagctgtgcagaacctgaagcaggcacaggctcaatacacaggactctgactctgtaacttttacagaattaaaattttttattttttttttaatcttttgatagagatggggtctccctgtgttgcccaagttggtctcaaactgctgtgctcaagagatcctcctgcttcggcctcccaaaatgctgggattacaggcatgagccaccatgtgtggctgacttttacagattcaagaaacccctctgtaaagacttcaacaatagaaacatcaaggatgcttgctgggccatctgggtcacttgcagttgcccatggaaaagggcttattctctgatgggaccatttacaatctaggggcttatcagctctatttctgatgcaaaggctaattacattcctcatttgttattcctgccgaaactgaagggaaggggagaatatatcacagagagtgactcctccatgcactcctgacagatcagtctctagatctcctctagggaatatgtcactggtattgacttggggttcccctttcttttttgttttctccttcctccttcctcctctctttctttctttctttcctctttccttccttccttccttctccttctccttcttcttcttcttttgacagggcttcactctgtcacccaggctggagtgcagtggtgcaataatagttcactgtggtgtccaccaccctctcaagtgatcctcccacgtcagcctcccaagtagctgggactacaggcacaaaccgccatgcccagctggtgtgtgtgtgtgtgtgtgtgtgtgtgtgtgtgtagacatggggtctcactatgttggccaggctggtctcaaactcctggccacaagggatcatcctgccttggcctcccaaagtgctgggattacaggaatgagccactgcgtcaggacaggttccactttctagactaattgcagtttgcaagtgttgtggctcagaaaacaatatcccagaatggaggcctcagaagcagcctcagaagtaaaagtttttctgtgaccttatcctgccctcttatctctcagtcccattctcccttgaggctagccatagaaactaggatccctcctccccaaactgggtcttagaaaccagaagtccttttctccaagctagtcatcaagcctaaaaatatgattctaattttccctctgtttttctgtgtaaaaaacaggccataaagaaattacctgtcctaccttgttcaactatataagtcataagacacccattccagagagggtcctgccccccatacccagaaggaaggaatgctgctcagaaaggcctagaagaatccagacagacgggtcttgctgggtttccccactcaatctatttgcattagatcataccctttttttccaatcatatttttgcctggctgtccatactttgttgaacctgagcatgaaaatggacaatgtcccctatatttttggatcttaattctgaaggctcccatacatacatattaaataaatttgtatgccttttctcctattaatctgcctcatgtcagggatttccagtgagcctttaaagggccaaggcccatggcccctacataacaaaggactaatagcctgactctgcttccctaacctttctcctggtgcacacactttggtaaggcactttgaccattcaatacagctgtcaccagcaaagcattgaacttttccagcctgctcactaaataaatgatagagacaaaagggataagaagttatgcaaacccatctaaatttgttttaaaatgtgaattttcatcccaatcaatttcagaacatcatgagtattactggttatttattaaattgttttttctgggctgggcacagtggctcatacctgtaattctactgctttgggagctgaggcatgaggatcccttgagcccaggaggtagagactacagagaaccatgattgtaccacagcactccagcctgggtgatgaagcaagaccctgtctcaaaaaaaaaaaaaaaaaaaaaaaaaaacctctatgaaaattattttgttctgcttgcatatgaccatttcagacaaaaggtctagaggagaatcgatgataatagaagaaatggaaagtttcgattacagaatggcacacactgattttctaacaatgaagaaaacacgaaacctgacacctggaaagagtcaagccagagagaggggacgttaatgatctctgtttttcaaaatggtttctgaaaactttccctttttcctgaaaaaacgctccccattcagccatcccaagctactgtaagtatattgaaatcacactgactgctgagcacacaatcacatctgacagagctgcaactagcgaagggacagcaggggcaacccagctcctgaacatcccactcagaacacctacagatgtcatccaggtttgtaaagaggaagaactggtgtcaatggttaacagaacctggactgactgccttctgtcagtccctctgaaaccaaggacacaaatgacttgtttggaatgcacagggaaccctagagggaaaggtcccacagtgggaggccaccctgggggcctttgcaagttcctgcctgactaatgtatgtcctgctgagggtgcacttaaaatggtaaatgttaggtttccagggatataatcatgtacttgcatgtgccccctaactatcctgatactgacttagctatgaaaggccttcacatcagcttcagcttactggccagaggtatgctgagcctgaattggtggcttgggttgggcaaaaaaggttaatgcaaaaatttaagtaggaagtcagctgcctttctaagataaaccttcatggttactgggatttgtattaattggctgtgatggtaaacttgatttgtcaacttgactgggccagagtacacaggtatttgttcaaacaccagactaggtatctctgtgcaggtaattttaaatgagactaacattaaaatcagtagactttgagtaaagcaaattacactccatgatgtgggttggcctcatccaataacttcaaggccttaaagagaaaaaagactgggtttcccccagtgaagaaaatattctgcctgcagactgtctgtgaatttgagctatcttacatgggtctccagaatgatgtcctgccctacataatttggatttgccagcccccacagttgcatgagccagttcctcaacatcaatttcaacaatctctctctctctctttgtctttctctctctctctttctacacacacacacacacacacacacacacacacacacacacacacggaggagcccgaaccaatagggtgcttacatctgggacccttaaagggcataacagagatcagtactgcaggttggtctcactctgctgcatgggttctaaggcagagtgctgtggtgttcccctcccaccctctacagactgacatccgtgtggctcatcactgtgatgcagggtttggccatccaaccattagaaatcactacaattccacaagggttctctgctctccttctgcctgtcatgtactctgttctatccggaagacacagcgatctactggatacgattccaaccttccaggaatgacctgaaaacctggtgagggagatacacttggaaagagaagttcagtgaaataacagcaacaggcatagctggtgtgttcaccaactcatgagagatcacactatcaacatcttccacttgattttccccatcaattaacagcttatcctggaaacaatccctttggtaggtaagttggattcccctcattgtttccccaaggcatgtggagctacaaagcaaactgatactggtatgttgtgtgagagtggagtccaagaatggaatgctctgcagtgatgtgattgccaaagcagtcaattagtctttgtaagttcccagatgaagtaccatttacaagcctctctcagtttacagggagtgacatgtatggaaaatccagtttatttaagactctggaaaaagtcatttgcctcactgtaacactcagtccccaaatgccagtagactccgccaatcattccaacaatcaaagctgccctccaaaatgccccaaagtgggcaatgatattctggccaccactttagaattcataagaagtaccctcaaaactcttatttacatcaaaaggataggaatgttgcagtcggtacaaaggaaataacacagcaccatggagcaggacacaatattcccgagaaaggattgtgggcaccttcctcctctgtgttgctttctgtgattaaaaaaaaagtggttcagggccagctggggtgtgcagtgaagcttcatttcaaaggtcaaccactgccatgggacattgatgctcaggatggttctgtggtagtcataactctggtatcctgagactagtgtccttctcctaggcaagggcagccccaggctggggcacaggagaaaaggcccaggctaggttgtcagtctgctagggacagctgtttgttgtgggatcacagatgagatcaggagaaggacaactgaaaggagaagagaggagaccatctcacactgtccaatatcacactgtcctgattaccatagttaccatacacatcttgaaatcaggtaataagagtcttccaatattctttgtcttttataaaattgttaggctattatattcccttttcttttccatataaattttaaagtcagcttgccaatttctattatagaaacaaaaggctgcaaggattttgattgggtttacattgaatgtatagattatttgagagaaacttatatattgataatcttcagtcttgcaatccattaacatggtatgtctcttcatttatttcagcttgcattaatatttctcagcaatgcttttcagtcaggtcttgcacacattttgttaaattttaccactaaatatttcatggggtttttggtgctatattaagtgatattgatttttaattttcaattgtttgttgctggtatataaaaacagcattgacttttgcatatttatcttgagcatgttactttgctaaactcacatttatgttcaagtcatggaataaattccatttggctatgatgtaaattttttatatattgctagtttttatatattgctaatttttattacacattttgtgtctatgttcatgagttatattggtctgtcatgttattttctcataatgtttggtttcgatatcaggttgacgccagctctgtaaagtgctttggaaagtgtgatctctcaccaattttcatgaagagtttgtgtagaattgacattaattttttttccatctccctttcctggtatggaattgtttcttccacaaacgtttggtggaacgcttggcagaattagccaatgaagtcaccagaaacttgaagtttatttgagaaaaatctttgttttatttatttgttgtttttatgaattccttttatttttatatagatatatatgtcatctatttatttttgaataagttttgttagctagggtcctttgaggaactttcccattaaattaaaaaaatacatttttttgataatatttttcataatgtatcatacatttaatatctgaaggatctgtattgatgtgtcctctagtattctctttctctctatcatcagtctggctaaaagtttattaatttttctgatcttttcaactaaacaacttctggtttcactgatttttttccaattgaagttctcatttctatttaatttatttctcctcatatcttaattaatttttccttcttcttgctttgggtacattttatttttctagtttcctgatgtggaagcttagatagttgatttggaacttttcttcctttttggtgtaagtacttcatgctataagtttccttctatgcactgttttagtttcatcttgcaagttttgatattttgtgtttttatctttaaattttccttgtaatttcttctttgagctctgaattacttaaaagtattgtttaatttctaatatttcatggattccacatatctttctataaataatttctatttcaaatattttgtggtcacagaacatgttttgtaaaatttcgttccttctgaatttgttgaggtttggttttcagcccagaatatcatctgtcttggtgaacattccatttacacttgagaagagtaggtattctactgttgttctgaaaatatcaattaggccaagctggtggatagtgctctctctatatatagatattatatatatatatatatatatatatatatatatatatatatatatatatatgtatatatgtatctatgtctatatatatccatatacatatatatacattattaggctttttctcatttttagggctaaagtgactttctgttgaggctttctgcatcttatgtggaggtagagctctcctttgtcaatattttgactactggtacaaaaatacagcattcaaatatttgaattaaaatataatccagggacaagctgagtatggcttgcaagctaactccagcccatggcttatttctgcacagccttggagataaggatttttttttacattttaaagtatttatatatatatatatctcctgaatttttgtttctaccaattgctaggaggaatgttgaagtcttcaattataactgcagatgtgtctatttcttctttctgatgtatcagtttttctctcatatattttgaagttgcatacatattcatggttttatgccttctcaataaatgcaactctctatgattgttgtgtgatgccccacttcattccttgtaatactctccactataaagtatgctttgtgaggtcttaatttagtacctctagtttttatgtgatttatatttgcaaggtccatcctttacttttaacttatttatttctaactggggttctttttaacagtatataatttgttcttgcttttttttacccagtcttataaactctgactgttttgtttttttttttttgagacaggatctcattctgtctgtgaacatggattccacttgtgtctgagacttccagggattccagctctcccaattgcctgtgtttggcctttatgaatgtgttacattttcagttgtttccttcttacccacttttatggctgtcatttcttccatacatgctgtgccggaggtgacgcagtttgtgtgtctcatctctcctcagaatgacttgtcacccttttatatcatggaacatatatcatgggaacatggctgacttgttagctctctgacgatctaataaaaaactgtaatgtcatacattattaggctttttctcattgttaggggtaaagtgactttctgttgaggctttctgcatcttatgtggaggtagagctctcctttgtcaatattttgactactggtacaaaaatacagtattgaaatatttgaattaaaatataatccagggacaagctgggtatggcttgcaagctaaatccagcccatggcttatttctgcacagccttggagataaggattttttttacactttaaagtattattttttaaaaacacaacaatatgccacagaaacgatgtggcccataaaaactgaagtatttactaccaggccctttaaagaaaaatttggtgaccctgtattcatctaatatctattattctgctttatattattgcatacattttcatccatttatttatttactcacatattgaaaagcatggattactttttgatcttgccctatcccctcaataaagcatccagctttatgatgccatggtctcaatctgggaaacttggcccagggctcaggtgaatacacaaacatatatctgaggtaggagaccggcaggacttgtttctggctataaccctgctgactaaaacaggatctgaattgggaggctgaggtgggaggatcacctcaggtcaggaattcgagaccagcctggccaacatggtgaaaacccatctctactaaaaatacaaaaattagccaggcatagtggcgtgcacctataatcccagctactctggaggctgaggcatgataatcgcttgaacccgtgaggcagaggttgcagtgagccaaaatcgcacggctgcactccagcctgtgtgacagaacgagactctgtctagaaaaaattttaaaaataaaataaaacaggatctgattcagacaggataaagggaagaaactggcagaaactagcagatggccatgagagtgatccctggctgccctccttgcttattagcatgggacgctcccacccagcagcatcatagattacaaatgccttggcaagaacccagaagttacaacagcttgccattgcaatgggctggaagttaccagccctttcctaaagagttcgaaataacctgctcccacccctaaatttgcattaacccgcccttaatatacacgtaattgaaagtgggtataagtgagtagaaatatagttgctaagaccccataggttgctgactcttggtttactgcctatcagttagccctgctctgtaagcagcagtaccattcaataaaagactgctgtctaacaccactagcttacctttgaattctttcctgggtgaagtcaagaatcatcctagattaagccacaatattgaggctcacttgtcctgcagcagtttcataccttggctgttgtaaataatgcttcataaacatgggagtgcagataacttttcaacatactgatttcatgtcctttggatatatatccagtagtgggctagcaattttgagggggaacctccatattcttttcccagtaataatgtacaagtgttccattttctcaccagaactttcatccttttgataataggcactctaacgggtgtgagatgagatctcattggtggtcttcatttggatttccctgatgattagtgatgttgagcattttttcatatacctcttggccctttgtatatcttcttctgagaaatatctattcagatcttttgccttgttttgtcctgcttttgttttgaaataaggtctcaatctatgtcatatgatcaaggctaactgcagtttcgaccttctaaactcaagtgatcttcccacctcagcctcctgagtagctgggactacagaaacgcacctttgctattaaaaacagcaaagtaaaaaggtaattttcacttttttggggagaaagtttctcacaattgttaactgcttggagttgcatagtgtagccaatgccagttttataatgtttttattccaattttaattttagaaatttcttttaaatgtgatattcaatgagtataaggtagaaaaaaataagagggaatttctttcatctcttagctcagtgcccactaagacacatgccacaggtttttggttccttcaggttgttgtaatagttaaaccagagaacccattagtagaagaatcaatgtcattgatgttgctttcacagaaaagggactggctccatagtcatgatagtggagaagtttgggagttagtaaaggagccaacctatgtaagttttgcacaaaaagagttatataaaaatagccaacttctgaaccccatgtacataatgatagatgagaaaatataaatatatttggaagaggctaaggcacatttacagatgacagactcctaagtggctactctgaaaagcagagatatccttgagcattcagagtgatgaacttttgtttcttgtctgctgactgaacaccatgattccttgccttcactgcagtgataaaacgaataaagataaagatgggatagatgtcaggacatgctattacagcaaatatcatagccttctttctggcacaaaaagctacattccattaactttaaccaagcaaaatcagaatccaaggtactctctatcctccacccaccaaatgatacctaaaaaggaaaattgtctttaccaagaaaatgtactcaagatagcacattactatttatttcatcaaagatttgtggttgtatactctgtaaagaaacttaatattaattttcttgatgttaaatattatttcttttctgattaaaaagtagtagatggtttttttagaaaattataaaatatggaatagcagaatcaaaactaacatccacaatttcaccactctgtggtaaacaatttgttgcacttctatccagtcttttataatttactcatctcttaaattgtacacatatatcaaaacatcatattgtaccccataaatatatatataattattatttattaatgaaacatttcttaaaaaagaaaaaaataatgaaagccatcaacaaccttaaaacaatatataaacagaaaaattattctttatataatatgacagtgtaaatattctttgtacacacacacaaaagtcttgaaatgggccgggcgcggtggctcacgcctgtaatcccaacactttgggagggtgaggggcgtggattgctttagctcagtagttcgagaccagtctaggcaacatggtgaaaccctagctatacaaaaattagccgagcgtggtggtgtgcacctgttgtcccagctacttggggagcagagacaggaagattaagccctggaggtataaggtgcagtgagtcatgtttacatggtgagccccagactgggtgataaagtgagatcctgtctcaaaaaagaaaacaaaaaaaaaaacccttgaaatgaaaaaaaaattaaagctcagtggaaataataaaagtaaatataaaaataaagtagaaaattagaacccaaacagttcaaattacaaagatatatgatcacttacacactttctagtaatctgagaataaaaaataaagtaaaaatgacattaaattttctcagtcaaattagaaaacccttaattatttttgaaaaaacaagaaatacccaatggatgtttttcataatgatgcagtaaaatgggtatttttataaatcacccattgctgaaatttttttgtttataattttctgttttataatttttcaacaagcaacatgaaaaactcaagatacaaaagaatgtttttaattatgtttaaaataatttatattaatgtaaagacatatttatgttatcatgcatacattttagaaacattggtccacttaaaaagcacataacattcttccaaatattttcaaactcgcattcgctctcttaatattttatggaactgtcaatctatttcccaactaatcatttgaaacctttttctttgtttctaaacataatattaggagtttttataatcatcattaattatttcagaatgctactctacttatgacaaatatacatttgtactttcacggagtagcagtatagcaacatatttagcatataaatagatttttattcagagttacatctaaaaatattacctatcattgaaagcaaatgctcacatgataaccacaactccaagtgttatggcttgcttatagtactgatgatgtgtcattgattagatatgatggtcacataagaatgataaggatcacacctagtacagggatcccggaaatcttgttggcatcaaatttggctacttggtcttcctaaacatcctaagctgaaagtgaagctgaatagaagatttaggacaagactttgtataaaatgcaaactttgaatgactgtatgcaatgagaaatacgccaataattaaagggatacctgattttaatgagaaagaaaacactacattccctctgtagttttgaagtagaagaaacgcaggacttaattcctggtcccgagaggatgaagtgaagaaacccgcatgaagcagcagatggcgataagagcaatccctagctgcattcattgcttatcagcataaaacagactcatgacagtttacacgacatggcagcattccagaagttaccacccctttccatggcaaccacccagaagttagttactaccactttccatggcaatgacacagaagctggcacccttttcctagaaagttctaaataacccacccctcaatttgcgttaaactgactcataatttaaagtaggtataaacgagtataaatacagttgccaagagcccataggttgctgacttctggctcactgcctgtgacttagccctacttggaaaggagaagtactgttcaataaaagtattgctgtctaacaccaccagctcacacttgaattctctcctgggcaaagccaagaaccctcctgggctaagctccaaatctgggctcacctgtcttgcatcagttataagaggagaacgcttccaaatattccatgattgcatatttctcaagttgatttgttaaaaatctttcatctttgtcatagtcaatgtgtcatttatctaagcattatggcgacataaaagctcaggtgtaacaggaattagtatgattaaaaatttagcaggattattgcccaataagatctaacatcaaatactgatatttaattgcattgaactcctccaattatgtaaggaaaagtttttaagaataaatattcgtgcttgaaaatatctttgaatacatgtaaaatggatcaaaactgaataccacagatgttgctgtcactggatgccaataaagtacataataggaaccataagacacaatcaataataaagggggaaataaaagggaacatatcaaagcaccatcacacgagtgcagaagcacacacatgaacacaccctgcagctgcagaaagacatggtgggaagtaaagccccacaactcatcagccttccttctcaccaactcatgagtccacaagtgagtttgctgagagtcaaatgctcacagtaaaactgacaaatttaaacatcactcagagctatttcaagcattatgtagaaagctacagacaacagtgaacttgctcttagcaagtcttaatctatcatcctcatcaatggctaaagaaattgtccctagacattttgtccaataacttctaaagtaatgaccttcaaactttttaaattacaattcatgggaaatacatagtttgtatataattcagtagggaaataaatatatgtatgtgtatgtgtgtgtgcagtctgtttgaatattctatatgcagtgaatgctatttactaatttattttatctcatttcttcaaaatgctgtttgtggaggacaacgttaatcttatgaaccactatggatgacaaaccagtatggaaaagattaaagccttttcacaagatatcctcaatggttaataagtgttattatagaagtatatgaaaagacacatgagaacccaatgttgtcttcctccttcggaattcagtcttttcagaaaaaaaatggtcgtttttgtttgttttttttttttttgttttgagacagagtctccctctgtcaccccagtcttggctcactgcaacctctgcctcccaggttcaagcgattctcccaccttagcctgccgagtagctgggattacaggactgcactacctcacctggccaacttttgtatttttagtagagatggggtttcacaatgttggccaggctgatctcgaattcctgacctcaagtgatccacccttctcggcctcccaaattgctgggaatacaggtgtgtgcaactgcacttggccaaaaacgtggtctttgatatgggccacaaaggctaccacaaaatatgtaattacagaggaaatgtgtgttccatcagcagataaccatgtctgttttgcacaggtgaagtgttacttggacagacataaaatcacatgcaaaagggacagaaagtacatgtgacctcttgtcctcttggtatcatgaggaggctttgtttgggctgcagcatagctgaatgtcatgaattgcatccattcacgcggacctccctgtgaatgcacagggacctccatttcccttttgtgctcccgctttatgaggcaaataggggagttgcaattaacatggtaggtagtaaataatttgacctcaaccaacaagcaatctgaagagctcaggtgacagtgtttactatggtactctgaaaactgccagctgctcagaatctgtagactttgtcccacccagccacagtcctgtggaaatctcagtttgttcatattccagtgcttggaggatgggaaggtcttgtcatgtggtgaaattgagcccacccacaggtagatgggctgtgttggtcccagctccaacttctcctttagcagccctcagagttgctagcgtcatgtatcaggcaagtcttcttgcctctaaagagtttctcatactttctgctgcttcctgtgagtgtcacaagggctacttcacaacttgctcccatcccaatccaattatgatcctttgaactcatccagctggaccagggtcacctgccatgggaataacaggaggaagctcaaatttgggaggaagttaaaacctgccctttgaagctggagtgtgtccactcaggaatcattaaaatccaggtccttgtgaagcacatccatccagccatctgatggcatgactttgaccatttgctaattcgatgctcacagaaaatctaaacccagatgtcactatctctcattctttgaacatttctgagtgcactatactaaaaaccggagttaataagggaaaaatgcaagtaaaatttagtaatgacaatgtccttgccaagaaaaaacaaaaaagataacagataaactaaataatagtttatgagtgccctcactccttaaataaactttgagaactacaatgactactcaagccactttttggagacagagattgaggaatctcttttttcctactcagggtatttccttaaaaggagtgcagctgtggccaggcacggtggctcacacctgtaatcccagcactttgggaggccgaggtgggcggatcacttgaggtcaggagttcgagaccagcctggcccacatggtgaaactccgtctctactaaaaatacaaaaattagctgggtgtattggcacgtgcctataatcccagctacttgcgaggctgaagcaggagaatcacttgaatctggggggcagatattgcagttagccaaagatcatgccactgcactccagtctggataatagagtgagactccgtctcaaaagaaaaaaaaaaagaagctcaactagatagaatatatagatgtcagttcaacaatatatcctaatttatttataaaaggctacattctgatcagggctcccttcctatccttcccttccatatactattccccacattaactgctaggtaatataaaagtaataagaacaggagtcatggacatagtttactgtctacattaacaagagtttatattccactgtcttcattatcataattttactaatacaggaatctcttaccaaggaaaataaaagtttcaaaaaaactttattgttctttccagcaattgcctgaaagatccatcaactcctcaataaaaagtgtcaaatgacatttttcaatcccaaaactctttgaacccattgcctaaaaagtcttgttgcatccaccaatcctaaatcattgtcattcctacccaattctaaccaaaccatcccccactttaaaatacccactttataccggacatgaaaagcacaacaaatatacccaaagcccttccacatctgacatactagtgcctctgtggaggtagtgctctaccttatagctttatttaaataatgtcagcgctgtcttatgaacaggttatttggctgctatttggggagtagagtatatgatgagcacagtcaccactgctgtacatcatgtcacaataaactaagtttaaatcctaggaccaatgttgtattagtccgttctcatgctgctataaggacatacctgagagtgggtaatttataaaggaaagaggtttaattgactcatagttctgcagggctggggaggcctctggaaacttaacaatcatggaagaagtggaagcaaacacatccttcttcacatggcagcaggagagagaagagtgagcaaaaggggaaaagccccttataaaaccattagatcttgtgaaaacttactcactatcaggggaacagcatgaaggtaaccaccccatgattacattacctcccacagggtcctttccatgacatgtggggattatgggaactacaattcaaggagagatttgggtggggacagagtcaaaccacatcatatgtatggatatttctgaaccatacactgtctgaatgacctacaggtatattcagggaaatcagttaccagtccagagattaaaatgtgcaataataccacctaaaaaaggaagaggtgtgaatttatttagtctacagaagtggttctattcattggtagcatggcagaaaacctcagaccagagaaggaagtgattaatcaaagtatgaataaaaattggccaaggtgggaggatcactcgatcccagaaattgagaccagcctggacaatgtagtgagattctgtctctaagtaaataaataaataaaatagctgggcatggtggcacacacctgtagtcccaactacttcggaggctgcgtcttgagtattgcttatgcccaggagatccaggctgcagtgaggtaaagtcatgccattgccctccatccagggcgacaaagtaacaccctgtctggaaaaaaaaagcatgtataaatataaacattaaaataatttatttctgtcacaaaaggtctttctgagacacatcaaccactaagggtgacatgggactctctgttcccaaagtttctggatgcatgagaatggtaggacaagagagagagaaaaaaaaatatctcttaagtccctttctttctactacaaacatactggggattctggttttgggacagtgggaaaaccctggctggccttgcatgtgcctgactcagtgtgaacgccccttactgcccaagtcccttgttgcccatgcgccttactgtctgccttctgtcccagcagagctgtgcaaagagacatcgtgacttccttctgtcttgccgactaggagtcagccagtaggtctgcagttcagtagtcctagaagtttgagtgtgagtgagtgtgaggaggagcctgcgggcacgatccatggcctcctaggtggaagggctttgaggtccccgtccttctaacacgcagcgatgcagccatggccttgctgtggtgggggtgccggacaagggagggagaaggaccatagatgggaggagggtcaggtaaacaagcagtgagttttgaagggggaaactatttgtggtatttgagtccgcgaggcatatgaaactgcttacagacgatgcattccagagtcctcagtgggaaccagggaggggagggaggactgcatgacgcgggatggggtggggcgaggcggggcactgcagcacacaacgcaggcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatgtgagtgaatgtgaggaggagtgagcgggcttccagagggtcaggcggcgtggtctgtggcctcagagagtaaaaagcttccaggtcataaggaaggtgggccgcggagtgaaggggagccagatgaagatagggtgaatgctcggggtgctgttggaggtatctgagtcccgaaagtgcctggaactcccaatgggacagattccagacttcttggtagggacccaggaatgggctgtgtaagcggtaagaaaggggcctgggaagtgggaatgctatgagctggtgaccgcgaccccgaggtctgtagagctccgggtagaaatgtccagcgaggagcgtccagtgatgtgtcacaacttctcaactccaccctggaggttcgaatgggcgggactgtgctttccaacaaaaccttgattttagggagggaaatcgtccaaacaaatgggtgtgtgacgaaagccgtggtcactgcagttttaattctctagctgtataaacttaaatgtctccactatggagaatccaactgtgaaaccaaatctcatcagaaatatcctgtatcttttgccaggagcattaagacattgctctgctagattgcccaacttaagtggctatgcaagcattcgattcagaagatgtacacacttctagttgccctgggacttactttcaaattatttccaaacttttttaaaaactgaaatttaacatttggccatgaaagtggtcaaatacagctatcctctcaaacacactttcccaatcacagtattctgtttgcagagtgaaatatgagttggcgaggaagatcaacatataggcctaggccaagaagaagtttacagcctcctgagctgattggggctatgcttgtgagtgctttaatattttgatgttttttattagcagaaatttcttttgtgatagtgttgttgaactagtatagatacactgataaaggtcttccatgttgataaaaatgatcatgcatctcatgaaggaaagactaatccaagagtattacaatctgattttgccttcatggataatcttgtgttccccatcatgacttcctcctcatgcttactgataacagattgcacacatccaacccaacatagattaaaatggtttccaaagcctttgagggtaactgtcttagagtaacctctctttgggaagagtaactttgtgaagaataagtatgtggaacagtgttggagaagtgtctttagacttacttgtgattagaaatacctgtgtattctgtatatttgtattattgacatgtattactaacaaaactttttatctgcacacatactgcctcccctttgtcccaggaacccactgatgaagagcctaaagaagagaaaccacccactaaaagtcggaatcctacacctgatcagaagagagaagatgatcagggtgcagctgagattcaaggtgctgggaaaggaaagaaataatgcctatagggggaaggaggcctatgtgtccatcatgccttatgccatgaccagtaataggaggaaagaaaacattaggaaaggatctcaagcacttgctcaaagtaggctggaaaagtgaagagtatagtttgcagcttcatgcagtccctggatataataaatcttctctttttttcaagatttattttgtatgcttgaaaatacatcccttgctaaatcagatgaaactgtttaatttgatgtatcaaaatgtacattatttcacttgattaatttgatcttcttagaatgttgctgtatgattggctcagccatggtgtccacagtgttataagcacccttttatagcatatagagtgccaagtcaccctaccttataacaccctgaataaagcccatttgcatagggatattagccctattttataaaaaggaaatggttgctcagagatagaggcttaccaagaacgcttgagtcatggaggcagaattcatattacgttccaaggtctgtgttcttcctaacatctacgttattagaaaacgtgaattattttgcttaaaacgcttaatactcgaatgtgtctgtactgtaaggtacttgagtattggctcaggagaaaacaaattcagtgaagcaggatagcaaatccggaaaagggctcaatgaatgacagccactgttccctttgatcagtattttttgacagtatgtttggtaaaaggtggatagttcaggacactggcatacaggtaggtatattagtatgctttttaaggaacttttaaaagttgcctaaatacttttataattagaaaactcaaagtatgatacaattatcatgaaacagaaattgtgtcctcaacagatagcattttcaagctaaagttgacggaatttggaccatggattattttagcagttcacggttaagaggtttccagaatatgactgtcaacaacactcattactttctttcactcaatttcctgaattctcatgggaaaactgtgactttttttcctcttatttttggtactatattctcaataggatttatttatgaaaagttacatttagggcctttggacctaagcataattttaattaattttaaccaaataattttcaaattacctcagcaagatatggttgtcacaattgtaagtttttgtcataagcccaggaatacattgatctagtctttcagaaaattatctttgagttattattaaaatgctattcatgcagcaaacttcagatatcttacatagttgatactcactgtttataatgcacactggcaaagtataggaaatgaaggtgtagtgtgatttatccttagattgtcattttatattagatttcaggccaggtacattggctcacacctgtaatcccagcactttggaaggccgaggctggtgggtcccttgagcctgagagttaggaactagcctgggaaacatggggaaacaccagaaaattttctctgccaaaaaaatacaaaaattagccttggtggtggcatgtgcctatagtctcagcctctcacaaggctgagacagggggataacttgagctcaggaggtcagggctgcagtcacctgtgactgcacccctgtactccagcctggatgacagagtgaaaccctgtattaaaaaacaaataaaataggaattcataatacaggaaaacaaaagtgtgacagctttgcatcacatttattatcacactagcctacaggcttttatgtcataactctgtggaatagaatattattacttccttatttatacttcatgtttttgtactcaagttcaataacctttgtattttttagtgcctgacctggaagccgatctccaggagctatgtcagacaaagactggggatggatgtgaaggtggtactgatgtcaaggggaagattctaccaaaagcagagcactttaaaatgccagaagcaggtgtgttattcattaagacacaaagttatgtgatttctattttttacaatattatacttttgatcatagagagataatattactgccactttaataacagtgttcaaatacacactttctttgaaaggtacttcagatcccaatgcctgactgcaagacttaaatgctctcagatacagacacaaattgggtcaaagccatattgaatcatcaaatatgacagcattttcttacttctgagtataaccaacagctaacaattttcagattcttttctaatttctgcttttaacaaatacataatgcatttgtaataccagactgtgtgaaatatgctgagtactgaaggagattctagtagcagctctatgacaatttgtgagaatctggacaaattccataaattctacacccatctttgctgttattgaaaatggtgaatgcagatcaaatgtattaaaatccgtttcaatgctgatttctgcatgctctggttctgttggagagaatagaaagatattctgattcccatgatttgtttttcctaacaatcagcttcagtccaattacaatatctgagctgagatttcattgctcctaagaaaatgagcaggcactctgcttgatgtttgttttccagcatggagacttgaatgagtgttcttggattttgtcaaattctgaattatctggcttttaaagaataattgtattttaaagccttcccaccgtgaagccttgaatgactgaataataaaatggcaagagacagtctactttctgtggccaatgaagtagggagaatgcatgtaggtcagtcatgctcaaggtgggtgtaagatgcctgtgctaagcatgctttttgctctcctgtcagtcttcatgagctactgtgtgtaataaagacacacatgatataatcacctctaaccatatcataggttacatattacaggtttctgccttgagacatcagatgataggacttaaagttcaaagactataatgtactaattcttgagtagtcaacataagtatcttttacacatttttttttataaattgctgactgttaatgagaagagcttctgaatttaaaggaagaactccatgtttagggaagaaattacctaaatgttttactctgcactgctgaaccattccattaaactatttacattaaaagatagttttcaggagccgattgaacaagcctcagttgtattcttaggaagatcacagccttaaatgcacatcttattagaatagatagcaaattacatgataaagtaataatcaatataataataaaagagcaacagaataaacctaatggaaaaggaaagaggtacttaataacagacaggtaggaacctggattttggattaggaaaactaatccaaaagtaatacatttaacacattgtttattttaaaaatagctatgaatagactatctatttgtttctccagtcttgaagaaaatgggaaaagcacaatacagaatatgaagaagacacagatattgaatatgtagtataactgaaagtaaatacattcttttgttttcttttgttttacttttgagacagagtctcgctctgtcacccaggctggagtgcagcagcatgatcttggctgactgcaacctccacttcccaggttcaagtgattctcctgcctcagctgagtagctaggagtacaggcatgcaccaccatgcctggctattttttgtatttttagtagagacgaggtttcgccatgttggacaagctgttctcgaactcctgacctcgggtgatccacttgccttggcctcccaaagtgctgggattacagatgtgagccaccacgcccagctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccaggagcctatttgacatccagaccatagtttcaagccaaaatattaaattgtacattttttataaattcctttgtttcttagtttttttgtgtgtatttgttatatttttagtaaaattatacacaatttttgctttatacattaaatccctttttaagagtttcacttgatttaatgtgttctgacctcggactgtcttttggtttccttgtagcactagaaagcagggtgtgtttaaaaaatattaataatgtatatgtttggaagtttatctccaaagtctccacagaggtctaattgaatgtaagccagagggtgactcttgggtttatggtcttagtccactgtacgaaacaaaaactttggtgtcatttgcatatcttaatgtgatctaaatacagttctgctagtaatgttccacctgttatgtttctattacaggtgaagggaaatcacaggtttaaaggaagataagctgaaacaacacaaactgtttttatattagatattttactttaaaatatcttaataaagttttaagcttttctccaaagaagtcttgcacatcttctgttaatttctttttttctttcttttttttttttttctagatggaattttgctctgtcgccaggctggagtgcagtggcatgatattggctcactgcaacctttgcctcctgggttcaagcaattctcctgcctcagactcctgagtagctgggactacaggcacgttccaccacacctggctaatttttgtatttttagtagagatggggtttcaccatgttggccaggatggtctcaatctcctgacctcgtgatctgcctgccttggtctcccaaagtgctgggattacaggcatgagccaccgtgcccagcctcttctgttaatttcattcccaggtattttgatactattgagaattgtggccaggtgtaatggctcacacctgtaatcccagtaccttgggatgctgaggtaggaggattgctagagctcaggaaagtgacaccagtctggggaatataggaacccctctctactacaatgagtgaatgaatgaatgcaactatagtctcagctactctggaggcataggtgggaggatcccttgagcccaggtggtcgaggatgctggtagtcatgttcacgccacttgcaactccaacctccatgacagagcaagactctgtttcaaaaaaaagtatcatttttgatattttgtattctgagttagctgatacacaagtgtggtatggtgaaatgtatatttggtcattgactgtgcttactggcatacaactcctataaagtgatgtctttttgtatgctagtgagttgaccaatgtctggcagtccctaggagctctaggatgaggaattagagggttgggactttcagccccatgcccaaacttcagggaaggttggggctgaaggttaagttgttcaccaatggcaagccaacattttaatcagtcatgcctacataatgaaaacctccatgaaacccaaaaggacacggttcagagagcttctggctagctgaacacatggagggtagcatgcccgtagaggccatggaaactccctgcccctccctgcatacctcaccctatgtgtcccctcatctgcatcttttctaagggtgttccatttgccacaaaatatgtgagaagtccctaggctatggagctagatgaaagaattagggcctaggtaggagtaagcggcaaggaaccagggcaacttgctgaagcaagatgacgggtcctacctacactgtctccttataggctatggcatgaaatacccatgggattccatcctgcctcttacacactggccttgagggggtgggcaagatattataatctgtgaggcaatgtccccatttctaaagtaggaattagaatatttacactaaatacttgttatgaagaataaatgaaataacatatggattaggcaatacactgtagataaatttggtttattatatttcttcttttaaaatttcaatttttttcattccctttgcctttacaaccacatgtttagtaagtaataactgctcttaaatttcaagtaggggtatcaagttacctttttaaatgaatttgacttctgagacttacttaatttaaataaatatattaattaaaaaccagggtagctggtgtcagacatgacatcaattctaaagttggtttgtgaataaacgcagtctgacaaggccaaccctaagtcaatggaatgtgccgaacactgtgccctttgctgtgtgtgatgccgtgaagaataagtccttctggtcagccaacaccacacaacacaatagtgtgtcaagtgttcaagcagtacacctgtagtggctaacggcagcaaggagccccactgccgttgttagtttggcttgtcacacatccatagatttgaccaataagaagacaatgagcccaaatgggtccaaatggttgattgattgcaggcaaagtaaaagcaaggtcagcattgtgtcagcactgtgtccctagtcccacagtatgacactgaatcggaggtatacaatgacagcacagacggtgggtctctctgcctgtgaggagcccacagctgtaccctaagacagtgagcagttttatactccacagttgtaccctaagatgaggaaaggcccgtgcttaatggaaactaggaaaatggataaagaatggtctcgtgtcaacctccaaccagatagggagctggtgagaaaatacctgtggcagctcccaccacgctgcctatctccccttgcaacaaaaggaatccaggtattcttccaacattcaggttagcctgcagtctggctttgcctacgtgtcctatgtggtgacctgcaagatctccaagacaccatggcagagcctttgccctatagtgtctgacacaaaaccatatgtaaggtgcctagaaacataccatctccaataatgactcctaaatagaggggatgcttttctgttagggtcattacaaaagactgataatttaattcaacagatatgcattgatgactgccatgttataggaaatgtcttggatgctggaaatgagaagaccaaccaacaatatgtggtacttgctgtggaggctgtcacactgttggtggggggaggagggcacctttacagaagacccttaaacagaagagcagctgaagtgcaaaggagaaacacagggaagggacccagggggataaaaacaatgaatgtggtggccaagtagcaggagtaaaacaagacagtttctcgaaaagataatttctccattgcctttgtgccttttctgaaaatcagtttatcatgtctgtgagtccattactggacttcctgctgatctgttgatttttccccaataccacattctcttgattactatagaattaacatgactcttgatattaggtagtgtgagttccccaaagttatacttcagaatggttttggctgttctggctcattttcctttctaggtaactttgaaaatttactccagtgaagttagttgtataagttgaggcagttttcctttgaagggcagcagataaacatgttagtagctacagaaggacatgggagaagaaggtgagttcccccttagctttgggaatgatccaatgtagagggagccattgatggttcaggagaggggagtgatcactgtaggagcaaagcccctgggaaggtggggggtatggatcctgagctgaggtgaggggctggcttcagttaagagcattgtatgtagaagggcaacagagaatgccagggcagacacgggtagactgggtttgggaacctctgataattcccagcagattgcttctgtcctctgaatgaatcactatgtctcaaaaataaacagtgttaatataaaactaacagtcatactgttataggctgagttgtctctgctcaaaattcataccacgcccagccttattttaatactgtctttagtaccatataggctgagttgtgtctgctcaaaattcatatggtgaagtctgaacccctagtgccacagaatgtaactatatttgagataggtgtggtctttaaagaggtaattaagtgaaatggggtcattagagtggtcctaaggcaatttgcctggtgcccttataagaagaggaaatgatgacacacacatgtacagagggaggactaaggcggacaccgggagaaaacagcagactacaaggcaaggagggaggccttagaagaaaccaattctgctgacaccttgatctcagacgtgtagcctccagaattgtgagaaaatacatgtctgttgtttaagccacccagtctgtggtagtttttgatggcagccttaacaaacagatagaaatacttttagtgcccttgtggaggtattattgtatctattttataagctagcactcctgcttcttctactaatgtaataaccatgtaatgatgtctatatctgagcaactgagcagtgatgagagaacttcaaaacctgaattcatgaccaagagagaattacttctcactttcactctcatcctgtttccaataccatattactctcactaaatgccaaaacccctcctcgatttgaatgaggtattttgtgagagtattatagtattggaaatttcttatcatgaagtcacttgttattaaattatatgtgttcagcatcagtaaaaaaatagtatggaagaataatcaagtctcataaaatacacagttatcatggaaatcatactagatttggagtacagtgaaatatgcctgttcaggcaactgcaggagacgtctgccaaacctatctgccccttgaagtcctgagacagatgattagtaggagaatcctgaagccactgcaaacactcacacattcaccattcacacctgccaaaatattccagcattcaccattcacacctgcccaaacgttcccacattcaccattcacacctgcttaagcattctcatgttcgccattcacacctgcccaaacattccatttaccattcacacctcccaagcattttcagattcaccattcacacctgcccaaacattcccgtattgaccatacacacctttgaccattttggggtgaaataagaaaatgacttctacttcccaaatcttttaagaggtgcatattattagcatcacctgggaagctgtggcacaccaccctctgcaagggatcctgggacgggtatttatcaagattctagcagtagccatacaagggagagcagaagagatgggagtgcctgttgttcaaatgcttgtggaaattatacctgccagggttttccatggtctatgttgtgaaagaagcttcctggacagtgaggttcatgtggcgatgtttccatgggccccctgagaatggtttggcaagagagaaaaaaaaagatctcttaagtcattttctttctactagaaatagcctgtggatgtgggtctggggacagcgggaaaaccctggctggccctgcatgtgcctgactctgtgtgtacaccccttgttgcccatgtgccctgctgtcagatcagttgtcccagaagtttcagtgtgagtgagtgtgaggaggagcccgcgggcacagtctatagcctcctaggcagaagggccttgaggttgttgtcctcctaacaggcagcgatgcactgcttgggggtgccggataagggaagaaggagggccatagaggggaggagggcctggtgaacatacagtgagttatgaagggggacactatttgaggtatttgaatccttagagcatatggaactaactgcccaaaaaggatggattccagagtccttagtggataccttggaggaagtggagaatgcagtgaggcagggtaccacagcctacaaggcaggcacccatctcactgcacatgctccttgtacctcagtgggcatgttcactgggcatggtccagtcggccccttcgaccacatggtgaatgccgtggagctgtgagggtgggagggtggcggtcctgtggtctagactctctcctctactgagacacagctggtaggtgcgaaggccagtccccccaggaggtgtagtgtgagtgaatgtgaggagaagccagcagacttcctgagcttcaggcagcctagtccctggcctcagcaggtgaaagccttcgacgtcatgagtaaggtggaccacagagtggaggtagctcaggtgaagatggggcgagtgctgaaggtaatgttggaggtatctgagtcctggaagcccctggaaaccccagtagaagacagattccagactcctcggtggggaaccaggaaggggcagggtgggtgggaaggaacaggcctgggaagtgggaatgctgtgggctggtgacccaggccccgaggtctgtagagtgcccacataggtgtccagtgaggagtggccagtgctgtgtggcaacttcaactcccccatggatgttcgaatgggctgggttgtgcatttcaacaaaacttgattttagagggaaaatgggcctagctaacagatgtgtaacgaaagctgtgttcactccaatttgaattctgtagctgtattttcctatatgtctccactatggaaagtccagttgtgaaactaaacctcatcagaaataccctgtgtcttttgccaggagccttaagacactgctaacttgaccaccttaagtggctttgcaagcattcgattcagaaggcacacacacttaaacttgtcctgggacttactttcaaagtatttccaaattttaataaaattacaagtttacatatggcgatggaagtggtcaaatacagcaatcctctcaagtgcactttcccaatcacagtattctgtttgcagaatgaaatatgagttggcaaggaagatcaacatataagcctagaccaagaggaagtttacagtttcctggactgattgggcttatgctcattagtgccttaacattccatgttttctgttagcagaaatttctatttgtgatagtcttgttgaactagcgtacatatactaataaaggtctgctgctgaaaaatgatcatggcatctcatgaaggaaaggcaagcccaagaggattacattctggttttgtgtggatgaatgatcttgtgttccccagatttcacccatgatttcctccccatgtttattcataacagattacacacattcctcccaacataaattaaaatggcttccaaagcccttgaaggtaactgtcttagagtatgacctccctgtgggaagagtaactttatgaagaataaggatatggaatagtgttggagaaatgtctttagacttatgatgaaaaatatgtattctgtacatttatattattgacatatattgataacagaactttctaatctgcataaacacacacccctcgtcccagcagcccagtgatgaagaacctcaagaagagaaaccacccactgaaagtcaagatcctacacatggtcaggagagagaagaagatcagggtgctgctgagattaaaggtgctgggaagggaaagaaagaatgtctatggtggcggtgggggcagaggaggcctatatgtgcatcatgcattatgccataaacagtaacagaagaaagaaaacattagaaaaggttctcaaacacttgctgaaatgtggctggaaaagtgaagagtgtagtttgcagcttcatgaagtccctggatgcaacgaatcttctctctttttttgaggtttattttgcatgcttaaaaatacagtccttgctaaatcagatgaaaccatttaattttatatatacaaatgtacattatttcactagtttaatttgatgttcttagaatgttgttgtatgattatctcagccatggtgtcaatggtgttgtaagcaccctttaatagcatgtagagtgccaagtaaccctaccctgtaacaccatgaataaagcccatttgcatagggatgttagccccactttataaataagaaaactgaggcttagagattgaggcttaccaagaacccttgactcacggacaaagaattcaaattacatttcaaagtttgtatttgtcctactgtctatgttattagaaaacatgactgattttgcttaaaatgcttaatactcgaatgtgcttctcctgtaaggtacttcagtattggctcaggaaaaggcacagttcagtgatacaggatagcaactccagaaacgagctcaatcaaaagaatactgaccaaaggaaacagccactgttcccttcgatcaatattttttacagtatgtttgggaaaagctggataattcaggatactggcatacaggtatattactatattggctatattagtatggtttttaagggacttttaaaagttgcttcaatacttttataattagacagtttaaagtataataagattgtcatgaaacagaaattatttcctcaaagggtagcattttcaagctaaatactgaccaaatttgggccatggattattttagcaattcactgttaaaaggtttccagaatatgactgtcaacaatgcccattaatttgtttgccctcaggttcccatactctcactgaagacagtgattttgatgttatatttggtacttttggatcccttccttacaccttacacaaaaatcaattcaagatggattaaagacttaaatgttagacctaaaaccataaaaaccctagaagaaaacctaggcattaccattcaggacataggcatgggcaagggcttcatgtctaaaacaccaaaagcaatggcaacaaaagccaaaattgacaaatgcgatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaacgatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaacccttgtggaagtcagtgtggtgattcctcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatattctcactcataggtgggaattgaacaatgagaacacatggacacaggaaggggaacatcacactctggggactgttgttgggtggggaggaggggggagggatagcattgggagatatacctaatgctagatgacgagttagtgggtacagcacaccagcatggcacatgtatacatatgtaacaaacctgcacattgtgcacatgtaccctaaaacttaaagtataataataataaaaaaaaaagtgggaaaaaaagttatatatggggcctttggacctaagcataactttcactaatttttaccccaaaattttcaagttacctaaacaggggatggatgtcagggctataagatttgtcataaacctgccactacattgatctaatccttcagaaagttacatttaatttatgattaaaatgctatccatgcagcaggcttcagatttcctagatatctgatactcactgtttataatacacaatggtaaagtataggaaatggaggtgtagtgtgatttaccctcagattgtcatttaaaataagatttcataatataggaaaacaaagacatgagatctttgcatcacatttattaccacaatagcctacaggattttatttcctaacactgagaaaaacaatattataatttccttatttatcattcttgtttgcctgcttcaattgataccctttaatatttcttagtgcctgacctggaagctgatctcaaggagctgtctcagtcaaagacgggggatgaatggggagatagtccgatgtccaggggaagattctgccaaaatcagatcaatttaaaatgccagaaggcggtatgctgtccattaagatgcaaaattatgtgctttctgttttccacaatattataattttgataatacaaagagagaacattactgcccctttaaaaacagaaagcagagttcaaatgcagacttactttgaaagttagttcagaccacagatgcctaactgcaagatttaaacaccaccagatggagacacaaattgggtcaaagctatattgaatcatcaaatattaaagcattttcttctgagtataaccaagaagcagaatcataagtgggcgccatctgtattctctttgttggactttggtatcaaggttacactagcttcatgaaatgaattgggatataaaacctctttctatgctctggaactgaaatccctgcaagaatgaatcacttggagatagggtttcccatgtgtgtttgtttccagattgcaggtctttttgttttgttttgttttgttttgtttcagctttggacactacttaaaagaaagatagaaggggcagctccaggtttccatgcctttaaactttgtaaggtgcctctcttccctacaaagatgcctctaattatgccgtcactctgaaaactacctgctcctgtttctgtactgacattaacctctgtatacagccagttaaaagttgccactctattaatttgcttacgtaagttttttcggagatacattcttgctaagttgcccaggctgatcttgaactcttggactcaagcaattctccctcctcatcctccaaaagtgctgggattacaggtgacagccaccttgcctggcctgcctacctgattttgatctgtggtgtatgtttttgaatggattgactacactaaagctgtgaatagttaggatgataactgcatttattgagttctttaatggaaataataactcatatttatagattgtctagtatctgttaaccggttatctgagctgtgtttcattatttctgacctcattattaaatccactaaaaaggtgagccagagttttcataaaatttacaataaatgactctagtaagaagcagatatggggattcaaggtctaagttcacagtctttgtgcttcctgaaagtaaatgcttctgaaagtgttgaatgcagaactggtgttgtgtatattgactttagtggtaatctgatgttttcatgtaaatccatggtaatatataaaatacatatattttattgtttaacataaaaggatttgttgttctctcgaagtatttgtcaaaatgtggaacataaacctaacacgggttcccagatgaaatcattgttatgaaagcattttaaaaattaataataacatacctgttttactgtgcaacagaaaaaatataataagaatactaaattcttttgaaatagtttgtgggatggagaaaagaactgatgtctcaatccccatggaaaaatgccacaacatctcctgcaaacatgtcctttctttaaatgatacaaggcagagagggagaaacaccaaacctttctttttcttctgagcctgacagtcaccacatctcaatcagaagcccctgcagctgcctggatccagcctaatatgcctcttcttgtacataatacacgactaacaaccctgagctccatttatatcctcacacccaaaaggataattctccaacaatgggccctactcagaatccacgctgcttagggaggggcagaagaatatacacagcaattatttctccctgttacaaagattttaaaacatttttggatccaaaaggactgaaaagctagggttcaaataaaaagtgagactaaatgtaggggatcccatttgccatggaatatgtgagaagtccctaggctacagagccagatgaagaattaggccctaggtagaagaaaggggaaagcaaccaccacaacttgctgaagcaaaattatttgggtcctagctacattgtccccttatggcacaaaataaccatgggtttccatcatggctctgacatacaggccttgagatggtagacaaggtacttatatcctgtgagatctttactactattgtcactgtcatttatttcattcttgcaattatcttgcaaggtaggaagtagttactgaagctcagaaagttcatctcttgttgaacctcaccaggaatggaagtactagtcaaacatacaaaactcacgtttgtgtttttgagtggagtttaactacgaaagtcagatttgttagatttattatagtgaatttatttgtcattatgttcagcatcaataaataaaatagtaatgaagactcatcaagcccagaaaaaaatccatgcacttacagccaattgatttttgacaaagttatcaaaaacacagagtgagagaagagcagccttcaataagtggtatcaggaaaactgtatatccacatacagaagaatgaaattctaccatcatctcttaccatatgtaaaggtaaacttaagatgaattaaaatcttataatgtaagacccgaatctatgaaactactagaagaaaacacaagaagacaactccatgacattggtctgggcagcgattttttggatatgatcccaaaagcacagggaagaaaaacaaatgtaaacaaatattacaccactacatcctgtacatgtagtggagtaatattatttgaaggcttactgttacttaaagatgcatgtagtaatccatagagcaatccctagaaaacaaagatatgtaactaataagccaatagtggagattaacatggtgtagtataaaatgttcaactcgtctaagagaagggaggaaacagaaaaacctgaataaaaaacagatatgataaataaaaatataaagcaagttggtaatttaaaggtaaactggttccacattaaatttaatttgcttacacttgtctattaaaagtcagagtttggccgggcccagtggctcatgcctctaatcccagcacttcgagaggccaaggccataccagccagggcaacatagtcagaccctgtctctacaaatattaaaaatgaggcaggcatggtggtgcacacctgtagttccagctcctgggggagctgaggtgggaagatagcttgagcccaggaggttgaggctgcagtgagctacgatcacatgactgtactccagcttgggtgacagagcgagaccctgtctcaaatgtaaaacgttagagattgtaagaatggataaaaagagcaagaacaaattatatgctgttaaaaagaaccacagtttaaaaataaagaagttaaaagtaaaggatgttaaaagtaagttcaaagtaaacagttaaaagatataccctgcaaatatgaatcacgtagaaactggaggtgctcaattaatacctcacaaaacacactttatagtggagattattacaatggacaaagtggaacattacataataatcatagagaggtgcattgattcagaagacagaaacaccatgagtatgtatgcaccatcaaaatacatgagggaaaaactgatacatcagaaagaagaaataaatagacacatgtgcatttatagtagaagacttcaacattcatcccagcaatcggtacaaagaatgtagagaaaaatcaggagatatatatatatatatatatatatatatatatatatatatatatatatatatataaaacagggggctttctgtatcctggggaacttgccttagtgaactggaaaaatcgcatcacacgtgggcttggaaaatcagtgcaaggttttattgaatggtggaagtagctctcagattgatggggagctagaaggtggagggagtgggaaggtggtcttcccctggagtcaggccgatcagtggccgaactctcctttgaccactgtggccaaattcctgtcggcaaccacatcactcagccattcaatggcctaccagcatttgctgctgtctgctgttgtgttcttctgccggtgtgttctgccggtgtgttcctctcgatgtccagccacctgtgtctctgcctggtaggatctcggggcttttataggcacaggatgggagcatggtgggccagggtggtcttggaaaatgcaacgttttgacatgaaaatagaaatgcctgtcctcacctaggtccatgggcacaggcccgaggatggagccttcaccagggaccctcctctactcctcccagcacttccctgccccactcttgtatcaacaatatatcaacatttgcaagatgacactagggcagtgtcacagagggaaataatactaataacgccacttctacacaacatcgtagccaaatgggatttactccatgacttgaatatatatatatatatatatatatatatatatatatatatatatatatatgagtttagcaaagtaatatggcacaagataagtatgcaaaagtcaatgctatttttatataccagcaacaaacaattggaaattgaaaatcagtattacttaatatagcagcaaaaaaccccaagaaatatttagtggtaaaatttaacaaaatatgtgcaagaccagtactcagaagcttaaaaatcactgtggagaaatatgtgtgtgtgtatatatatatatatatatatatatatatatatgtagagagagagacagagtctcgctctgtcacccaggctggagtgcagtggcgcaatcttggctcactgcaacctcactgcagagaaatattaaagcaggctgaaacaaatggagcggtatgctacgttaatggattgcaagattgtgaaatgtcagtttctctcaaataatctatacattcagtgtaaacccaaccaaattccatgcagccttttgttttaagaaattggcaagctgacttcaaaatttacgtggaaaagcaaggggactagaatagtctaacaattttataaagaacaaagaatattggaggactcattacctgtttcaagacgttttcacaactatggtaatcaggacagcatgataatggcataagaaaagaaataagggtccaaatctagacctatatattcagattaaattgatttttctatagggtgccaagataattcagtgggaaaaaatgatttattcagggaatggtgctggaacaattggaaattgacatgcaaacaaatgaacctcaacctttgtctcacatcatatacaaaagttgccttaaaatgcatcatagaactaaatgtaaaagccaacgttatcaaactgctagacgaaaacgtaggagaatctgtagcatcatgtaaaactaagataggtaggatatgaaatgcacaaactatgaaatagaaaaatcatgatctttttagtatttatatacttatgtactatccttatccagtcactagttacttttccaagcgctatacaaatcgcatgaagaggtcattagagttctaatttcctagagaaatttccattcaaattttccacacaagttcatgatgatgaaaccccagcattgcatttaggcttcacaataaccctgtgaggagagctgaatattcattacgcttataaaaataagctgtcccccaagctacctagcttcagttcttgagtccctgaagggctaaagtgataatcaaaagatcatccaaagggtcaaatgtactcttgacgttgtctctctggaacatgctccagggaaatgtgggaacaacaacgatataaacagcaaaacaataacagctagaattgattggaaatttatcatatggcaggcgctgtcctgacaactgtacatgtcttaacagtcagtgttctaaactgcccaagaagtagatgactttactagtagtatttccatggtactaatggagaaaggagtcacagagatgttaaggatgtttctcagtgtcacccagcaatgagtggtggagccacaggtcagaggcgtcatgaaaaactctactgtgttgcatatttatgtaaccaagagtaagatccaaaggctattgcaaaatatttagaattttacagtatgagattgcacaggctagagacatttgatttcttcagaaatatttaagagatggagacttgaaaggattggtctgggtatgatttggagacaggccctgagagcatcattagaataacaggcagcatgtcagttttagtctcctcacctgaaggccgtgggttcgtccatcagagaacacaccaaacctgtcccttctataccttcacaaaggagaaagaagctgtgtagcttggaaaggagactattcccctgctccagtagttctcagacaaatttccatgaaaattttaacccaggatcttttaaaaatgcagattccactattcacacccggtgaatctcatgtagtgtggccacagtggtgccttaggatctgggaatttactgcccagcctaggaaacattcagaaaccttattaaatccctttggtttcatgactgcctccaatatacccactcttcccaagactgacgtgaggttgagaagaccgacctgagagcacacaggaacacaagacatgatggacacagtgtaagagtcaccataagggtaaggtagtgcatcttttgagaagaccttataactcctactggtctttcttcccaaaggcctcttcttgtcatgcacagtgaatggaagggtgtcaagaaatgaccttttagatacccaaagggtatgggctcctatcagcaaccattgaacacataggatgggaggtcatgtaatctaccatctccctcccaccagccttgatttctttcttgcactgtcatgtccttccacaggaatctggagcaatgccaggacttagggccaatgtcttctcttcactagcagacacctacctgcacctcacctgaggagatcgtctcccttctcctttcagctatccttctcctgatctcatctgtgatcccacagcaaacagctgtccctagtagcctgatgacctagcctggcccctacctcctgtgtcccagcctggagaaggctgtctttgctgaggagaaaaacaccagtcccaggatcccagagccatgactaccacagaaccatactgagcgtcaatgtcctatggcagtggttgatctttgaaatgaagcttcaccacacaccccagctggcactgaaacactttgtttttaggttgaaagactttgttatttatttatttatttatttttaatgaaaaaatattgggaaactggtggtgtttgttcacatgagtaagttctttcgtggttatttgtgagattttggtgcacccatgacccaagcattatacactgcacccaatttgtagtcttttatccttcacctccttcccatcctttccccctgagtccacaaagtccattctatcattcttatgcatttgcatcctcatagcttagcttccactcatgagtgagaacatatgatatttatttttccattcctgagttacttcacttagaataatagtctccaacctcatccaggtcattatgaattccattaattcattcctttttatgactgagtagtattccatcatatatatatttctttattcatcgattgatgggcatttgggttggttccacatttttttgcaactgcgaatcgtgctgctacaaacaggagtgtgcaagtatctttttcatataacgacttcttttcctctgggtagatacccagtagtgggattgctgaatcaaatggtagttctacttttagttttttaagcaatctgcacactgttttctatagtggttgtattagtttacattcctaccaggagtgtagaagtgttccctgttcactgcatccatgccaacatctactatttttttatttttaaattatggccattcttgcaggagtaaggtggtatcatattgtggttttgatttgcatttccctgatcattagtgatgttgatcattttttcttttttttaattatactttaagttttagggtacatgtgcacaacgtgcaggttagttacatatgtatacatgtgccatgttagtgtgctgcacccattaactcgtcatttaacattaggtatacctcctaatgctatccctcacccctcacccctccccccaccccacaacaggccccggtgtgtgaagctggaaaccatcattctcagcaagctatagcaaggacaaaaaaccaaacaccgcatgttctcactcataggtgggaatcgaacaatgatcattttttcatatgtttgttgaccatttgtatatcttcttttgagaattgtctattcatgtccttagcccactttttgatgggattgttcgattttttcttgctgatttgtttgagattgttgtagattctggatattagtcctttgtcagatgtatagatcatgaagattttctcccactctataggttgtctgtttaatctgccaactgttccttttgccatgcaaaagctctttagtttaattaagtcccagctatttatctttgtttttattgcatttgcttttgggttcttggtcatgaaatccttcccttagccaatgtctaggagggttttttaatgttatcttctaaaatgtttatagtttcaggtcttagatttaagtccttaagccatcttcagctgatttttgtacaaggtgagagatgaggatatagtttcattctcctacatgtggctagccaattatcccagcaccatttgttgaaaagggtgtctttccccactttatgttttgtttgctttgttgaagagcagttggctgtaagtatttgggtttatttctgggttttgtattctgttccattggtctatgtgcctatttttacaccagtattatgctgttttggtgactatggccttatagtatagtttgaaatcagatatgtgatgcctccagatttgttctttttgcttgttcttgctttggctacatgggctccttttttggttccatatgaattttagaatttttttctaattctgtgaagcatgatggtggtattttgatggaaattgcgttgaatttgtagattgcttttggcagtatggtcattttcacaatatggattctacccatctatgatcatgggatgtgtttccatttgttcgtcatccttgatttctttcaacagtgttttgtagttttccttgtagaggtcttttaccttcttggttaggtatattcctaagtattttatttttttgcagctattgtaaaaggggttgagttcttaatttgattctcagcttggtcactgttggtgtataaaagagctatgatttgtgtagattaattttgtatccagaaattgggctgaattcttttatcagttctaggagctttctggagaaatctttaggtattctatgtaaacaatcgtatcaacagcatacagtgacagtttgacttcctctttaccaattttgatgcccttaatttctttctcttctctcattgctctggctaggacttccagtactatgttgaagaggagtggtgagagtgggcatctttgtcttgttccagttctcagagggaatgctttcaactttctcccattcagtattatgttggctgtgggtttttcatgaatggcttttattacattaaagtatgtcctttgtatgccgatttttctgagagttataatcataaagggatgctcgattttgtcaatgctttttctgcatctattgagatgatcatgtgatatttattttttattctgtttatgtggtgtatcacatttattgacttgcatatgttaaaccatccctgcatccctgctatgaaacccacttgatcatggtggaatatctttttggtatgttgttggatttggttagctagtatttttttattattaaactttaagttctagggtacatgtgcacaacatgcaggtttgttacataggtatacatgtgccatgttggtttgctgcacccattaactcgtcatttacattaggtatttctcctagcatctatgttcataagggtattggtctgcagttttcttttttggttatgtccctttctggttttggtattaggatgatactggtttcatagaatgatttagggaggattccctctttatcttgtggaatagtgtcagcaggattggcaccaattcgttgaatgtctggtagaagtctgctgtgaatccttctggtcctggatttttcttttgttgttggtaatattttaattaccatttcaatctcgatgcttcttattggtctgttcacggtatctaattcttcctgatttaagtgagtagggttgtatctttccaggaacttatccatctcttcaaggttttatagtttatgcatgtaaaggtgttcataatagccttaaatgatcttttgtatttctgtgatgtcagttgtaatatctccagtttcatttcttattgagcttattaggattttctctcttcttttcttggttaagcttgctaatggtctatcaattttatcttttcaaagaaccggattttttttcatttatcttttgtatttttttgtttcaatttcatttagttctgctctgatcttggttatttcctttcttctcctgggtgtgggtttggtttgttcttgtttctctagttccttgaggtgtgaccttagattgtctgtgctctttcagactcttggatggaggtgtttaggctacgaactttcctcttagcactgcctttgctgtatcccaggggttttgataggttgtgtctttattgttgttcagtttgaagaatttttaaatttccatcttgatttcatttttgacccaatgatcattcatagcaagttatttaatttccatgtatttgcatgattttgaaggttccttttggagttgattttcagttttattccactgtggcctgagacagtgcttgataaaatttcaatttccttaaatttattgaggctcattttgtggcctatcctatggtctatcttggagcaagttccatgtgctgttgaatagaatgtgtattctgcagttattggatggaatgttctgtatgtattggttaagaacatttgttccagggtataacttaaatccattgtttctttgttgactttctgtcttaatgacctgtctagtgctgttagtggagtgttgaagtcccccaccattactgtgttgctgtctatctcatttcttaggtctattgctaattgttttataaatttgggagctccagcgttaggtgcatacatgtttatgattgtgatattttcctgttggacaaggtcttttatcattatataatgtccctctttgtctttttaaacttctgttgctttaaagtttgttttgtctgatataagaatagctacccctgctcacttttggtgtccatttgtgtgaaatgtctttttccacccctttacctcaaatttgtgcgagtccttctatattaggtgagtctcttgaaggcagcagatagttggttggtgagttcttatccattgtgcaattctgtatcttttatgtggagtatttgggccatttacattcaacgttagtattgagatgtgaggtgtcattccattcattgtgctattcgttgcctgtataccttgattttttgttttgtgtttttgttttttagattgtatttttgttttataagtcctgtgagattaatgctttaagaggttctgttctgatgtgtttccaggatttgtttcaagatttagagttccttttagtagttcttgtagtggtggcttgatcgtgctgaattatctcagcatttgtttgtctgaaaaagactgtatttttccttcatatatgaagcttagtttctctggatacaaaattcttggctgataattgttttgtttgaggaggctgaagatagagccctgatctcttctagcttgtaggctttctgctgagaaatctgttgttaatctgataggttttcctttataggttacttggcacttttttctcacagctcttaagattctttcctttgtcttaactttagataacctgatgacaatatgccttggcggtgatctttttgtgatggatttcccaggtgttctttgtgcttcttgtatttggatgtctagttctctagcaaggctggggaacttttcctcgatggttcccccaaatatgttttccaaacttttagatttctcttcttcctcaggaacaccaactattcttaggtttggtcatttaacataatcccagacttcttggaggctttgttcatattttcttattcttttttctttgtctttgttggattgggttaattcaaagaccttgtctttgagctctgaatttctttcttctacttgttcaattctactgctgagactttccaaagcattttgtatttctgtgtgtccattgtttcctgaagttttgattgttttttatttatgctatctatttcattgaatatttctcccttcacttcttgtatcactttttggatttccttacattgggctttgcctttctctggtgcctgcctcattagcttaataactagcctcttgaatgctttttcaggtaaatcaggggtttcttcttggtttggatccattgctggtgagctaggttgatttctggggtgtgttaaagagccttgttttgtcatatttccagagctggttttctgcttccttctcatttaggctggctctgtcagagggagggtctaggactgaaggctgttgttcagattcttttgtaccacggggtattcccttgatgtagtactctctcaccttcctatggatgtggcttcctgagagctgatctgtagtgattgttatctctcttctggatcaagacacccagcaagtctaccaggctctacgctggtactgggggttgtctgcacagagtcctgtgatgtgaaccatcctgtgatgtgatgttcctaggaggattatggctgtctctactgtgtcacgcaggttgttagaggagtcagggaaagcttgcagtcacaggcctcacccagttcccacacaatctgaagggctggtctcactcccaccgtcccccacccaacagcaccaagtctgtttccaggcagtgggtgagcagggctgagaacttgtcccaggctacctgcctcctagctgtgaaagtaagttggctttccttcttcccctgcctatggaatctgcacaccggattcacaccctcccccaagttctggccaggacacttggatcagttcaaattgttactaagttcagctggagatttccttctttctgtggccttttcccagtgcctctggctgccctcctgaaggactcttgtgaggccaagcagagacgacttgctagggaacacagcacactcacagggctttttctgctgcttcctctactcctgtattttgcttagctctctaaactgactcagctccaggtaaggccagaatcttcttcagtaatctagaccttcagtttccccagtgggagtgtgtgctcagggttgggtgatctccctttcccacttccacagtttgggcactcacagtatttgggatgtctcccaggtcctacaggagcaatccgcttccttcagagggtctgtgggtcctctcagatttcccaatttattcctgcagttgttctggagcaaaaattcatgatgtgagcctccacacactgctctgtccatccgagtcagtgctgcaatctctctttctttgttgttttaattgagacaggatctctttctgtcgctcagcttggagtgcagtggacaaatcatggctcactttcaagctcaagcaatgcttccatctcagcctccctagtacataggactacaggcatgttccaccaaccctggctatgttttataaaattttttgtagagacggggtctccctatgttcccaggctgatgtgagccaccacacctattctggaatcacattcttatcacagaaaacaagacataggaggaaggttcctgcagcccttcctggggagcattgtgttctccttcctggtgccgtgttatttcctctgtgccaaccacaacattcctattcttttgatgtaaataagaagtttgaggatacttattttcaatcctaaacttgtgatttatagccagaatatcatcgcccactttgaggcattttggaaatatctgtgggctgctgctgttgttggaataattggcaggagctactggcatttggggactgagtgttaagtgaggcaaacgtcttgttccagaattttacataaactagattttccatacatgtcacttccttgtaaactgagggaggcttgcatattgcttcatctgggaacatataaagacttatttactgctgtggaaatcacatcactgcagggcatttttttcttggattccactctgtcacaatataccagtatcagtttgctttgtagctgtgcatccctggggcaaatagtgaggggaattcaatttactgaccaatggggtcttttccaggataagttgttagttgatggggaaacttaagtgggagatgttcacagtatgaagtctcatgagttggtgaacaacatcggctatgcccattgctattactgcactgaagttctctttgcaggtgtatctccctcactaggctcccaggtctttcctggaaggttggaaacatacacagtagatcccagtgtcctcaggatggagcatagaatgtgacaggcagaaggcagggaacacttgtggaattgtagtgatctctacatggttggatgaccaaacccagtgtcacagtgatgagccacatggatgtcagtctgcagagggtgggagagacctctgtcttaggagccatgtaggagagtgacacctacctgcattactgatcttggttacaccctttatggatcccagatgtaagcagcctattgattaggcttcttctgtgggtgtgtgcatgggaagaaagagagagattgattgattgattgattgattttgaggaactggctcatggaactctgtgtgctggcatacccaaaccttgcagagcaggatgtcaggctggagacccaaggcagaggtgatatgatacctcaaatctaagggcagcatggagcctgaaattcttgatcttgaggaggaccccagtctttttctctgaaggccttcaagtgattggacgaaggccactccacattgtggagggcaattaagcttacccaaagtctgctgatttaaatgttagttctcatgtaaaaaatacctttcacagagacatctactctgctcaaggtgaacattttttgtgtgtatcgtggcctagcaaagttgacatatcaaacttcccatcacagccatcttatacaaatcctattaatgatggatgtctaccttaggaaggcagattacttcctacctaagattctgtattaaactttttttttggccaggccaagccaccatttcaggctcagcacaactctggccaggaagctgaagctgatgtgaatgccttccagggatgaggcagtgaagggatagtcagggcgcacatgtaagaaaaatctcagagggcataggtgatacccctggactccaagagtttacccttgatagggcaccccccagcaggacatacagttgtcaggcaggagctggccaaggcccccactgtggcctcccactgtgtgacctttccctctaggggttcctcgtccggtccaaataattcatttgcatctttggttttagtgggactctcagaaggcagtcagttcagggtggtcattgacacttgttcctcctcttcacaagcctggatgacatccctaagtgttctacatggaatgttcaggagctgggtcacccctgctgtcccatagtcacagctgtcaggtgtgatcgtgatctcagtattcagtgtggttccagcattggctttagggtatggttgtgggctcctcgcaggcaaggagacccaccacctgtgctgttattttgtacctccaattcagtgtcatactgtgagactagggacacagtgctgacacaatgctgatcttgctttggctgtgccttcaagcaatcaatcacttggatccacttgggctcattttgttcttactggccaaatctatggatatatgacaaatcaaactaagaactgcaatggtgatacctgtggcccttttagccaccgcagggctgcttagggatttcttgagcactttacacactattgtattgaggtgtgtgttgtgttgcctgaccagaatattgacttattccttgtgaaatcacactgatccaggagaacagtttgcagcacatactactgactagcacatactaatgacagcattaatgaacatatttatgtaaatcaaataatcttgggaggtcaaatgcattttaaaatgcaatttggtattttcttacaattccaaagcagttatcacttactatagatgtagctgtaaagacaagtcaaatgaaaaaataaattgtaaaagaaaaatatataactagtaaacaacattatctgcaatgtaatgcctacttagtatattatttcatttattctccatagcaatcatttactgtaaatattctaatttctactttagaaatgtggaaatagtcccacagggtataagtgccttgcccaccatcttgaagcccgagtgttagagccacgatggaaacccatgccaatttcatgctataccctataaggagacagggtagctaggacccaagtcattttgccttagcaagctcccctggttgctctcccctttcttctacctacaccctaattctttcaaccaaccttacagccttgggacttctcacatattttatgtcaaatgggatcccctacacttagtctcactttttttttcaactctatcttttcagtcattttggatcagaatatacattaaaatctctgtaagagggagaaataattgctgattataatcccctgctactccctaaacactgtggattctgagtagggacctttgttggaaaaatatctttttgggtgtgaggatacacatggagctcagagttgcaattggtgtattatttacagtaaaagggatatcaggctggatccaggcagctccaggggcttctgaatgagatgtggtgactgtcagggtgatggagttttatgcagatggaaaaagaggcttggtgcttctccctccctgcctcttaataacttttaaagaaaggtcagaagcgtttgcagaagttattgtggcatttttccatggggactgagaaatcccttctctctgtgttcccacaaactattccaaatggctttagtgttctatttttctgtagcagagtaaaataggcatgttattattaatttttaaaaatgtttttgtaccaatggtttcatctggtaatgtctgttagctctatgtgccatattttgggaaacaccttcttcaagataagaccaaaatcttttatgttgaaaaatgaaaaatatatatattttatatattaccatagatgtgtatgaaaatatgcaattaccaataaaatcaacatatacaacactagttctgtattcaacactttcagaagtatttactttgagaaaacacagactgtgaacttagaacttgaatcctcatatttgcttcttactagagtcatttgttgtaaattttatgaaaactctgactcccctttttaaaggattaaatgaggtcagaaacaatgaaacatagctcagaaaactggctaacagatactgaacactctataaatgtgagttattattcctattcttcttaaagaactaaataaatggagctattgtcctaactattcacagctttggtttagccaatccattcacaatcacataccacagatcaacatcaggtagacagaccagccacggtggcagtcacctgtaatccaagcacttttggaggctgaggagggagaatcacttgagctcaagagttcaagatcagcctgggcaacttagcaagaacacatctctgaaaaaacttatgtaagcaaattaatagagtggcaatttttaactttctgtgtacagaggataatgtcagtacagaaacaggagcagattgttttcagagtgacatcatcattagaggcatctttgtggggaagagaggtgccttacaaagtttaaaggcatggaaatctggagctgccccttctgtctttcttttaagtagtgtccaaagttaaaaaagatatgcaatctcaaacaaacacacatgggaaatcctatctgtaagtgattcactcttgcagacatttcagttcctgagaatagaaagaggttttatatcccaattcatttcatgaagccagtgtaaccttgataccaaagtccaacaaagagaatacagatggcccctgactcctgatgccgccatttaaaatttcttgacttcatgatagtgtgaaaatgaaatgcgttcagtggaaacagttttttgagtagccatataaccactgtgtttttcatctccaggaaaatattcaataaattacatgagacattcaatgttatgataaaataggctttgtgttagatgattttgcacaactgtagagtaatgtaagtgtaactgtaactgtatggtaatataactgtagggtaatgcacaactgtagggtaatgtcaacgtaactgtaactgtagggtaatgggcacttttaaggtaggctaagctaagctataatgtttgctaagttagtgtactgaatgcatcttcaacttacacaattttcaatttatgatggatttattgggacataatgtcatggtaagttaaggagcatctgtacatgaaataaaaatataggctaatgccacttatgaggacatacataaaaatcctaaacaaattagtaaggcatagattattaaaaaaggataatatgttgtgacccatttttttcccctagaaaggcaaggtttgtttaaacatagcaacttaccaatgaaattcaccacgttaacagattaataaaagaaaaagtcctatgatcatctgtgtggatgcactacaagtgcttgatgaaattcaacatctattgaagataaatactcctaggaaatgaggaatacaatggaactctctattgtgataaagtgtatctatattaaaaaacacaggaaacattgtaaaatgttaaaaaaaactttccagtgcctattaggcataagagaaggatggccacaattactggttctattcagcattctattgggtgggtctgtccaatgttgtaaaataggaaaaaggacaaagcgtactgtttgaaatgtcagaaacaagctgttgttattcaaagatgatatgattgtgtaagttgaaattcagaaaggatctagagataaatttggaataagtatatttagcaaggttactggatagaaaaccaataaacaaacactgaatccattgaatggattaaaaaagttttttctctgttcttacctcacaacaattaacatggaagagttttgtgatcaaatgtgtgggggcttttctacacacaccaaacaagcaatgagttttgcagcacacaccagctgggtgtcctctcattcaattctgacacaagctaccttgacatagagtaagattgcacaggttaagggctcagtcccataagatttccctcactacaagccctaggttgtttcacctgtgtttctgacccaccagctataaattgagttttccatgagtcctactcaggttcagtcagttaatttcctacagcatctcacaagactcagggaaacacatacgtttatgggtttattaaaacaggatattagaaaggatgcagataaagagatgcatagagtaaggaatggggaaaggggcaaggagcttccatgccctctacaggcatgctgccctctttgtgttcagctagccagaagctctctgaaccctgtcattttgggttttttggaggttttcattatgtagctatgattgatgaaaccaatggctagccatttttgaccaagttaaccttgagtccctctcatttccctgaaggttaggggtggggctgaaagtcccaaccctctaatcccccatcctagagctacttaggggctgccagccatcagccaactaattagcatacaataagatatcattttttggagattctaaacattttaaaaactgtatgccagtaagcagggtcaaggaccaaatacacatttcacaaaatcacacctgtattagaccattttcacactgctataaagaactacctgagtctggggaactgatgaaggtttaattgactcacagttccacaggcttgacagcaagcataattggaaggcctcaggaagcttacaatcatggaggaagggaaagcaagcacctcttcaaatggaggcaggagaaagcatgaagcgagaagtgccacacacttttaaaccattagagggttggaactttcagccccaacccttgagtactaactgactgtcaggagaacaacaaggaggaaatccactcccatgatccaatcacctcccaccaggtccctctccaaacactgggaacaattaaacatgagatttgggtggtgacacccagccaaaccataccaacacttgtataccaactcaattttcaaaatttcaaaactttgaaatacaaaatttaaagaaatgatacctttactcttgaaaaaatctccctctgtcactcaggctggagttgcagtggcatgaacatgcactgcatcctctacctcctgggctcaagtgatcctcccacctcagcatctggagtagcttgaactacagctacataaatacatacattcagtcaatcatttacttttgtagagaacagggtctcactattttgcccaatctggtgtcagtctcctgagctcaagcaatcctcctgcctcagcatcccaaagtcctcagattacaggtgtaagccactgcacctggccacacttttcagtagtataaaatatgtgaaataaaattaacaaaagatgtgcaagtcttctttgaataaaactgtaaaactttattgagatatttttaagtcaaatatcaaatataaaaaccgtttgcattctttcagcttctcttcatttaaaactgtggttgcccttcacgtgtaacagaaacataacaggagggaatattactagcagaactgtatttagatgacattaaaggtatgcaaagttttggttttatgcaaaagactaaaactgtaagcctaagtgtcaccctatggctaacattcaataagacccctgtagggactttgaagatagacttccatgcatatacagtattaactttttttgaacccaccctgctttctgtgctctacaagaaaaccaaaagacagtctaaggtcagaacacattaaatcaagtgaacctaataaaaagtggctcaaagtggaaagcaaacattgtgtatacatttactaaaaatatcactgatacacaaaacatctaagaaaaaaaggaatttacaaaattgtataatttagtgttttggcttgaaataatagactggatgtttgacaagctcctaggaaacagttaatgtcacatcaggaactgcataagtacattgaatggaaaagcccatactgtatttgtttgtctctgtggcacaaaagtgcaaaaatgtagctttagctagtttacacttctgtggatttcaaggtacagtaactatttgtccaaggttttcacctatcattatgatgtcaatatgaagagtgcctctttttacacctgaaagtattcccttttgtaaaataaattacatggtcacattcgttttaatctatcactatcattttagatagaggcatatatcatgaacaatggggcaaaaaaaaaaagaaatggagggagaggaaaatggaaaaggagagtaagacatctttaaaaggcaaatatttgtttctagaagtaagtgtttctgagtgtcaactggaaaatttcagaagttcctccacagtgtttgtgatgtttagatattcaggtattcctgagatatatttactaatgtatgcattcctagtttatcaaccatttcgtccatattttgaaaatactagagttcaagaatatattcactttcaattataccgtatattgagttctgttagggtcttgttcatattctgtgttgagcttttaccattttcttcaggattatgtaaactattagatactctattcatagctatttttaaaaagaacaacatttcaatttattgcttttggattacgtttccttttcctaatgattcataccttttattcactcctgctttccttttcccttaagtttattctgtgggtcttctattactatttttatttattattatcactttcatttatcctgtaatttgctattttaataagatatgcacttaaggctatgatcttcctaagaatacaatggagccttgttcaatagactcctggaaatcgtctgaaaactatcttttaatgtaaatgtctaacggaatggttcagcagtgcagagtaaacgcatttaggtaatttcttccctaaacatggagtccttcctttacattcagaagctcttctaattaacagtcagcaatttggaaaatatgtgtaaaagatacttatatctactactcgggaattagttccttatggtttttgaactttaaatgctattatctgatgtctcctgcctcagccccccaagtagctgggactacaggcgtgtgccaccatgcccggctaatttttgtatttttagtatagacggggtttcgccatgttggccaggctggtatcaaactcctgacctcaagtgatctgcccacctcagcctcccaaagtgctggaattacaggcatgagccaccacacctggcctgaactctgtttttaaaggagcagtaatgttctctctttgaattatcaaaagtacaatgttatgaacagtgagtatcagctatctaggaatctgaagcctgcttcatgaatagcattttaatcatgatttaaatataattttctgaaggattagatgaaggtattggtgggtctatgacaaacatagtcctgatgcccatcccctgttgaaaatgttttagttaaaattaattaaagttatgcttaggtccaactgtcctatatgtgactttccatatataaatcccattaagaaaaaagtactaaatataatagcaaaaccactgtcttccagtgaaagtatgagaacctgagttcaaagaaattactgggcattgttgacgatcttattctggaaacctcttaagagtgaattgctaaaataattcatggcccaaattctgtcaatgtttagcttgaaaatgctacccattgaggaaataatttgtctcaagataatcttatcacaatctgaattttctaattataatagtatttaaacaacctttaaaagtcccttaaaatcacactaatatatctatctgcatgccagtgtcctgaattatccagcttttccacatatactgccagaaataccaaagaaagggaacagtggctgccattcattgagctcttttctggagttgctatcctgcttcactgaactgtgttttcttgtgaggcaatattgaagtactttaccatacagacacattcgagtattaaacattttaagcaaaatcattcatgttttctaacaacatagatggtaggaacaacgcaaatcttggaatgtaatatgagttctgtctccatgagtcaactcttcttcataggcctcaatctctaagcctcagttttcttatttattatatagaaaggactatattttcaagcatacaaaatacatctcaaacaaaaagagaagattcattatattcagggactgcatgaagctgcaaaatatcctcttcccttttccagccaactgtcagcaattgtttgagatcctttcctaatattttgtttccgcctgttactggtcatggcataatgcatgatgcacacataggcctccttcccccatagacattctttctttcccttcccagcaccttgaatttcagttgtaccctgatctctgtcatgaacaggtgtaggatcctgatttttagtttgtggttcctcttcttgaggctcttcatgactgggctccaggggctaggggtatatatgtgtgtgtgcagataaaaggtttttttcattaatacatgtcaataatataaatatgcagaatacagagttttccctgatcatgaataagtctaaagacatttctacaacactattccataaacctattcttcataaagttattcttcccacagagaggttactctaagacagttacactcaagggcttcggaagccattttaatttatgttgggatgaatttgtgtaatctgttatcaataaacatgaggagagattcaggtgcaaaatctggggagcacagatcatccatccaggcaaaaccagaacataatattcttgggctagtgtttccttatgagatgctatgatcattttttatcagaatgggatacttttatcactgcatctataatagtgcaacaacactaccacaaaaagaaatttctgctaatagaaaacattgaatgttaagtcactcacatgcataggcccaatcagctgaagaggttgtaaatatcatcttggtctaggcctatatgttgatcttcctcgccaactcatatttcactctgcaaacacaatactatgattgggaaaatgcgcttgagaggacagctatatttgaccactttcatggacaaatgttaacttgcaaaatttttttaaaaatttgcaaacactttgaaagtcccagggcaagtataagtgtgtgtgccttctgaatcaaatatttgtaaagccacttaatgtggtcaagctagctgagcaatgtcttaaggctcctggcaaaagacaggatatttccgatgaggtttgatttcacaactgaactctgctctgtggagacatttaggaaaatacagttagagaattaaaactacagtgaccacggcttttgtcacacatccatttgctaggcccatttcctctgtacaatcaagttttgttggaacacacagtcccatttggacatccagggtggagttgtgaagttggcacacagaacagggcactcctcactggacagctcttcagggtgctcaagagatctcgggcctggtcaccagcccgcggggttcccagttcccaggccctttcctaaccatccacctccctgtttcccaggtctccaccaaggggtctggaatgtgtcttctgttgagggttccaggtgctttcaggactaagaaaactccaatagctccccctagcactctcctcatcttcacctgcaccccctccactctgtggcccaccttcctccttcattctgagtgtcccacaaggcccatggcaatgctattacaccaggaaaaggacgaagactcttcaccctccaaggtcagggactatgctgcccaacactccagaagctcactggctcctccccacactcattcagacttcaactcctgggaggactggtctgaggttctaccagctgggtccaaattggggaaaaaggatccagaatgcaggaatgcaaccctcacaccctcacagctccacagagttcaccacgctggcaaagggatcaattggaagatgtccagtgaacatgcattgaggtgggcattcaaggagcatgcaaagtgagattggtgcctggtgcccagcctcacaccagtccatttggcaccctgtagtcctgcactctttcaccccctttcaggtccccattgaggactttggaatccatcctctgtggggggtttcatatgcctccaggattcaaccaccacaaataatttcccccttcaaaactcactccatgttcaccagaacctcctctgctctatgactttccttcctcccctgtccaggccccccaccacagcaaggccatagctgcgtcactgactgttaggagaaaaacggggacctcaaagcccttctccctaggaggtcctggaccatgactacgggctcctcctcacattcactcacacttcaacttctgggaggattgatctgaggatctaccgacttagtcgtagtcagtgagacagaaggaagtcatgatgtctacttgcacagctctgcagaagacagcaaggcgcacgggcaacaagggacttgggcagcaaggggcgtgcacgctgagtcaggcacatacagggcaggccagggttttcccgctgtccccacacccacatccccaggctgtttgtagtagaaagaaagggacttaggagattttttttgtctctctctcttgtccaaccagaaactttgggaacagacagtcccatgtcactcttagtggaggatgtgtctcagaaatatctgtgacaaaaataaggaattttatgtatatatatatatgtgctttttcctcagtgtattgctctgtcacccaggctggagggaggtggcatgaccatacctcactgcaacctctatctcctgggctcaagcaatcctcatgctgcagccctctgagtagttgggaatatgggtgggtgccaccatgcccagctaatttatttatttttttagatgcaaggtctcactgtgttgctcaggctggtctcaaatacatggactcaagtgatcctcccacctccgccaatttttatacatgccctgattaatcacttccttctctggttcagggttttctgtcatgtgcacaatgagtttgactatctgtatactcaataaattcacaccattttactttttaaggttgtgttgttgcacatttacatctctagactggtaactgtttttttctgaattttcctgtagatcattcaggcaatagggttctgaaatatccatagatattgatcgtagcttctaggctcagtctactgtgatatgatgcacagcagtggtgactatgctcatcatatactcccaaatatcagccaaacaacctgttcataagacagtactgacattatttgcataacgctgtaagaaagagcactacctcgacagagacactcgtatgtcacacatgtggaagggctttaggtatatttattctgattttggagtctggtgtgaagtgcattttttaaagtgggggatggtttggttagaattcggtaggaatcataataattgaggattggtgaacacaacaagaggaggatttttagacaaagggttcaaagagctttggcattgagaaatgtcgtttgacacattttactgaggagttgatggatctttcaggcagttgctggaatgaacaatagttttgttttttttttttttacaacttttattttccttggcaagggattcctgtattactaaagttacattgatgaagccagtggagtataaactctcatttatgtagatagtaagctgtgtgcatgattcctcttcttattacttttatattattcccagttttatatgagaaatagtatatagaagagaaggataagaagggggccctgatcagaatgtagcttgttgtaaacaaattaggatatattgttgaattgactcctatatattccatctagctgggctccttttaaggaaataccttgagaaggaaatgtgtggttcctcagtccctccctccctctctgtaaaaagcagcttgagtaagaattgtggttcttcaaagtttttttaaggagtgagagtagtcataatcctgatctattattaatttgtcttttatctttttggttcttttttggcaagaacaccattaaattttactttcttttgtcccgtattaactctagtttttagtatagtgcactcataggttctcaaagaatggatttagactttctgtgagcaactcattagcaaatggtcaaggtcatgtcatcagatggctggacggttctgcttcacaaggacctggaatttaatgattgctgaatggctccactccagcttcaaaggccaggctttaacctcatgccaaatgtgagcttcctcctgccattcctgtgggagacaacccaggaccaagtggatgggttaaaggatcataatggattgggatgggagcaagttgtgaagtagcccttgcaacacacaggaaacagcagaaaatatgaaagatactgtagagacaagaagagttgtctaatacatgaccctagcaactctagctgctaagggaagagtcagagctgggaccagcacagccggtctacctgtgggagggctcaatttcccacatgactagagcttcccatacttcaagcacaggaatctctgaacaaatttggatttcaacaggatggtaagtggacaaagtctacagattctgaggagttagcaattttcagagtattgtagtgaacattgtcacctgaactcagaatgcttggtgattgaggtcaaattatttactacctatcatgttaagtggaagtctcctacttgcctcataaaaggggagcagagtagggaaatggaggtccctgtgaataaatgcatttagctatgctgcagcccaagtgaagcctccacatgaggccgagaggacaagaggtcacatgtacttgctgtctcttttgtctgtgagttcttgtctgtccaagtaacacttcacatgtacaaaacagacacagttatctgcagatggaacacacatttcatcagtaattacatattttgtggtagcctttgtggtccacataaaagacgacctttttgtctgaaaagactgaattcccaaggagggggcaaaattgggttcccgtgtgtatttgcctatacttttttttttttttttgagatggaatctggctctgttgcccaggctggagtgcaatggcgggatctcggctcactgcaacctccacgtcccgagttcaagcgattctcctgcctcagcctcctgagtagctgggactacaggcacgtgtcaccatgcccagctaatttttatattcttcgtagaggtggggtttcaccattttggccaggatggtttcgatctcttgatctcgtgatctgcctgccttggcctcccaaagtgctgggattacaggcgtgagccactgcacccggcctgcatatacttctataacagcatttattagccattgaggatgttctgtgaaaaggattaaatattttccatgctggtttgtcatccatagtggttcctaagacacatgttgccagccacaaacagcattttaaagaaatgagataaaataaaatagtaaatagcatttattgcatatagaatatttaaatagactgcacaccaacatacacatgcacatatttatttgcctagtagaatatacacaaatggtgtatttctcatgcattgtaactgtgtatttctcatgcattgcaataaacattttgaagttcactactttagccattatcagacaaaatgtctagaagccagttctttaggcttctgtgaagatgatggattaagacctgctcagaataagttcactgttgtctgtagctttctacataatgcttgaaatatatctcagttatgtttatattggtcagttttactgtggtcatttgaccctcagtaaacaaatttgtgaactcctgagttggtgagaaggaaggctgatgagttgtggggctctacttcctaccatgtgtttctgcagctgcagggtgtgttcatgtgtgtgcttctgcactcatctgatggtgctttgatgtgcttctttcatttccctcctgttattgttgactgtgtcttatggttcctattatgtacttcattagcatccagtgacaatgacatctgtggtattcagtgttgatccattttacatgtatttcaaaatattttcaagcatgaatatttatttttaccaactttcctttaagtacttggagaagtccagtgcaattcaatattagtatttgatgttagatcttactgggctataatcctgctaaatttccaatcatactaagtgttgctacacccaagcttttatgtcaccataatgcttcgatatataacacattgaccaagacatagttgtaagattctgagatattcactttttaaatttcctacttttaagttcaggcatacaaatgcaggaggaggtgcaggtttgttacataggtaaatgtgtgccatggtggttgcctgcacagatcatcccatcacccaggtattaagaccagcatccattagctattcttcctgatcctctccatctgctcactccctgctctttgctaggacccaatcaatgcatgttgttcccccagatgtgtccatgtgttttcatcatttggctctcacttttaagtgagaacatgcagtatttggttttctgttcctgctttagtttgctaaggataatggcctttacctccaaccatatccctgcaaagaatatgatctgattcatttttatggctgaatagtattttatggtgtatatgtaccatattttctttatccagtccaccactgatgggattgatacatcaagtatcacaataacacgtggtacttgctgtgagggctatcatattgtgatggggcagacagacccttacagagaaaagcagctgaaatacaaaggagaaacacagggaagggacccaggagaataaataaacagtaaatgcagtggccatgaagcaggaagaaaacaatacaatttcttgaaaagataatctttctcctttgcctttgcacctcttctgaaaatcaatttttaatgtctgtgagtctattgctggactctattctaatctgttgggatttttcccaataccacactgtcttgattactatagaattaacataattgatgtatgaggctggatgattaaaatcatcataataaaataataagtaaataaataaataaaattaatatgaatcttgtcattttgtagtgtgagtttcccaaagttatgcttcaaaattgttttgtcctggttcattttcctttctagataatttacttcaatgtagtgggttgtttacattgatgcagttcttccttcaatggcagcagataaatgcattagtagctactgagtgacacgggggaagaaggtgagttccaccttagcttgaggaatgatccaatatagagggagcagttgatgcttcaggagagagaagtagatcactgcaggagcagagcccctgagaaggtgggaggcgtgggatcctgagctgaggtgagggggctggcttcagttaggagcattctatgcagaaggatgggagataatttgagggaatcactgaaagcgagggtggtcttggggatccctgacacaatagcagcagcagtgtgattcaccagcaagaccatgactcactataaaatgtgaaatccttcttccaataaaggaagagtgaaggggtagagatgatgaagctgtaacaccttggagactatggatttccccataatgtgaagcagctgccgacctgctatctgttagaaacacatgtactcccagcatttaacaataatccctccaactgcaagagagggggctcactggatccctcgtccgcagttctgtgctggataatttaagggggaaaagtgcagccagatgctgactttggcttttcttttcttctaaaggcaggtaaggaaaggacccatacgttaccaaaggtgagctttgtgtaggccaaaaatgttaaaagtttgaatttctctttcctccaagtgggaggaaaataatcagtttcctggacttctgtaaagccttagatcaaccttaagccttagataaatgaaaaaaagcagggagcggggcggggggaaggccgcatgcaatggctcacacctgtaatcccagcattttgggaggctgaagcatgagaatcacttgagaccaggagttcaagaccagcctgggcaacatagtgaggccaggccaaaattttaaaaattagctgggcatggtggcatagcctgtagtcccacctactcaggaatgtgaggcgggaggattgctggagcccagaagcccgaggtagcttaagttatgatcccgccagtgcaccccagcctgggcaacagagggaaaccctgtttcaaaaaggaggttgggggagtgtgaagacacattccggccttgtcttcagctgggctaccgctgctgcagccccctcccaaacatttgagccaggatccctcttggccatggtacttgtgactctgtaatgctgaatttagtgctagcagtttgaaggaaatttccatgagaagaaaaaagggggaagttttaaactggccttgcatcttgtggctattacatctggatgtgtgatgatattgacggaagaggtccggcagtttgactactcagtgaagcagccacaaaccagggagtgatgttttccatgcttctcactggataaatgatagagaaaaaagggatggagtttctgtaaacccattttttgaattttgacaaattcaagatttcatcttgactatttcttaaacatgatgaatcttttcacctaaattatattaaaatacttttttctgaaaatccttttgtccctcttgcagagaactcttccagaaaaagaggtctagagaaaggaaggggatgattaaagaagtaaaatgtttgcatcacaaaatggtatatggtgatttttaacaattggagaaaacatgaaacctggcaataaggagaggcaaaggagggagggaggacattagttgtctctgtttttcaaaattgttgctaaaaactctccacttttcctcaataaatactttccatacaggctttccaagccactgtgagccaacgttgaaatcacactgactgctgagcccacaatcacctacaggtattcagggatttcagttaccagtccagagatttaaatgtgcaataacacaatgtaaaaaagtaaagaggcatgaatgtattgagtctacagaaatatagttaaattcattgtatgcatggaagaaaacccagaaccggagaaggaagtgattaatcaacgcatgtataaaaattggcccaggtgggaagatcacttgagcccacgtatttgagaccagcctgagcaacacagtgaggccccgcatctaaaaaaataaataaataaataataaaaataataaacattaaataaattagctgggcatggtggcgtccacctgtattcccaactactcaggaggctgcagcatgaggattgcttgagcccaggagatggaagctgcaatgaggtatggtcatgccaccgctctccagcctgggcaagaaagcaacaccctgaaaaaaaagcatgtgtaaatatggacataaaattccttatttctgtcacagatctgagacacatcctccactaagggtgacataggactgtctgttcccaaagtttctggatgcatgagaatagttgggcaagagggagaaaaaaaaactggccgggtgtggtgactcatgcttgtaatcccagcactttggagggccaaggcagggggatcacctgtcaggagttcaagaccagcctggccaacatggtgaaaccccgtctctactaaaagacaaaaaattagccgggcgtggtggcgcacacctgtattcccagctactctggaggctgaggcaggagaattgcttgagcccaggaagcagaggttgcagtgagctgagatcatgccaccgcactccagctgggcaacagagcaagactctaaaaacaaaaacaaaatctcaacttcctttctttctactacaaacaacctggggatgtgggtctggagacagcaggaaagccctggccggccctgcatgtgcctgactcaatgtgcatgctccttgctgcccaactcccttgttgcccgtgcactgtgctgtctgccttctgtccctgcagagctgggcgaggagatgtcgtgacttccttctgttgtaccaactacaaataagtcggtagatgctcacgtcaatcctaccagaaagttgaagtgtgagtgagtgtgaggaggagcccgtgggtgtggtccatggcttcctagggagaagggccttgaggtccttatccttctcctaacaggcagtgatgcagccatgggcttggtgtcatgggcagcccagacgcgggagtaaggagggccatagaggggaggaatgtcaagtgaacatggagtatttttgctgttgttgtttgtttttgtttttgagacagggtctcactgtgccacctaggctagagtgcaggggcatgatcatggttcactgcagcctcaacctcctgggctcaggtgatccttccacctcagcctcccacatagctggaactgctggcaggcacaaccatgctcagctaattttttgtatttttagtggagaaggggtttcaccatgttgcccaggctagtctcaaactcctggtagagtgagttttgagcagggaaactatgtgtgttatttgagtaccagaggcatatgaaactgctcacagaggacagattcagaaatgctcatttgggacctgggagagagcagaggacggcagcgggggatagagtattgtgaggtgggtcaccagagcccacaaggcaggcaccaatctcactgtgcatgcttcttgggggctggcctcagggcacatgttcattatgtgtcttcccgtgggccccttcacccacgtggtgaacgcggggaagctgtgaaggtgtaaaggtcaccgttccagcagtctggactctttctcccctactgagactcagctggtaggtctgcaggccagtcctcccagaagttgaagtgtgaatgagtgtgaggaggagtcagtaagctttggaagggtcgggtgatgtggtccctggcttacagggagaagagtttcaagttcatcgtcctcctcttgtgggggcgccgccatgggccctattgtggggagtgtcagaatgagggaggaaggaaggctgcagacaggggatgtggggtcaggtgaacatgggggtgctgttgtgggtatctgagtgccagaagggcctggaacccccgacagaggacagattccacattcctcggtggggacccacgaaagggtggcgtgggcactaaggaaggagcctggaaactcggaacgctgcaggctaatgaccatggctccaaggtctgcagagcttctgataaaggtgtccagtaaggagcgcccagtgctgtgtgacagcttctcaactccaccctggagtttctaatgggcagggctgtgcattccaatgaaacttgattttgggggaggtgtaaaatgggcctagaaaatgggtgtgtgatgaaagcagtggtcactccaattttaattctctaggtgtgtaaacttaaatgtctccacaatggaaagtccagttgtgaaaccaaacctgattggaaatactgtgtgtctcttgccagaagccttaagacattgctcaactagcttgaccaacttaaatgattgtgcaagcattctattcagaaggctcacacacttataactgctctaaaacatactttcaaagtatttccattcttcaaaaaaaaaacaagttaacatttgtccacggatgtggacaaatatagctatcctctcaagtgcattttcccaatcacagtactctgtttgcagagtgaaatatgagttggtgaggaagatcaacatataggcttacaccaaagtaatatttacaacctcttcacatgattgggcttctccttatgagtgacttaatattcaatgttttctactaggagcaatttctttttgtggtagtgttgttgaaccagtatagatacactgataaagttctcccatgttgataaaaagtgattgtggcgtctcatgaaggaaagagtaacccaagaggtctacatcctggttttgcctgaatgtgtgaacttgttttccccagatttgactggtgatttcctcctcatgcttattcatagagcattacacacattcaacccaacataaataaaaatggctacccaagctgttgagggtaacagtcttagagtaacctctctatgggaagagtaactttatgaagaataagtatgtggaatagtgttgggatagtgttggagcatgtctttaaacatgcatatgattagaagtatctatgtaatctgtattcatattattcacaggcattgataagaaattttttatttgcacacacacacgcacacacacacaaacacacacacgaacacgtgtgcatgcgcacacacacaccccttgtcccaggagcccagtgtgccagagcctcaacaagaagaaccaccagctgaaagttgggatcctacacctggtcagaagagagaagaagatcagggtgcagctgagattcaaggtgctgggaagggaaaaaaagaatgtttattgggagaaggaggcctatatgggcatcatggcttatgccatgaccagtaacaggaggaaagaaaacatgaggaaaggatctcaaacatttgctgagagttggctggaaaggtgacaggcatagtttgcagcttcctgcagtccctggatatgatgattcttctctttttcttcgagatgcattttgtaggcttgaaaatacagtccttcctaaatcagataaaaccatttaattggttgtataaaaatgtacattatttcactagtttaatttgatcttcttaggatgttgcagtgtgacctcctcagccatgctgtccacagtgttgtaagcaccctttaatagcatgtggagtgccaagtcaccctaccttataacaccctgaataaagcccacttgcaaagggatgttagcttcattttataaataagaaaaatgaggccagacagcgcagtggctcacgcctgtaatcccagcactttgagaggcctatgcgggataacctgaggtcaggagtccgagatcagcctggccaatatggtgaaaccccgtctctactgaaaatacaaaaattagctgggcatggtggcacacccccgtaatcccagctattaagcaggctgaggcaggagaatcccctgagcctgggcgacggaggttgcagtgagccaagattgtgccactgcactccagagcaagtgggtgacaaagactccgtttcaaaataaatacataaataaatgaataaaaaatgaataagaaaactgagcctcagagattgagacttaccaagaacaattgactcatggagaaggaattcatatttttgttccaaggtttgcattcttcctaccatctatgttagaaaatgtgaatgattttgcttaaaaatatttaatactcaaaagcatctgtattgtaaggtacttcactattggctcaggacaaaatgcagttcagtgaagcaactccagaaactagggcagtgaatgaaagccactgtttctttgaggtgtatttttgacagtatgtttggtaaaaagctggataattcaggacactggcatacaggtaactatattagtaggattttcaaggggcttttaaaagttgtttcaatatttttataattagaaaactcaaagtacgataagattatcatgaaacagaaattgttttttcaacggatagcattttcaaactaaagatagacagaatttgggccatggattattttagcaattcactgttaaggggtttccagaatatgcctgtcaacaatacccattgatttctttgcacttcagttcccatactctcactggaagacagtgattttgctgttacattgcatacatttttcttagtgacattcatgtatggaaagttacatgaagggcatttggacctaagcattactttaattaagtttaaccccaacattttcaaggtacctcaacagggtatgagtgtcagaactataagatttttcctaggcccaccaatacatcgatctaatcatagaaatttacatttaagttttgattaaaatgttatccatggggcagtcttcagatttccaaggtagctgtgtgtgtataatatacaatggtaaagtatgggaaatgtaggtgtgctgagacttatcctccctgaaatgactgccttctgacagttcccctaaaccaaagatgcaaatcagttgtttggactggacgaggaaccttagagggaaaggtccctcagtgggaggccatatcgggggccttggccagctcctgcctgatgactgtatgtcctgctgggggtgccctaacaagggtaaactcttggtgtccaggggtatcacctgtgccccgtgggattgttcttacctgtattccctgactagcccatcactgcctcatccctggaaggcattcacatcagcttcagcttcctggcaagagctgtgctgagcctgaaatggtggcttgggctggacaaaaatacagaatcttagttaggaagtcacctgtctttgtcagatagaccttcaccattaataggatttgtataagatggctgtgatgggaaatctgatgtgtcaactttgctaggccacgatacatgagaaatgttcactttgaccagggtatatgtctctgtgaagggttttctttacatgagaactagcatttaaatcagcagacttcaagtaaacctaattgccttacccaatgtgggtgggcctcatccagtcccttgaaggccttcagagaagaagactggggtcctcctcaagttgaagaaattctgcctccaccctgcccttggatttgggctctcatatcacctctgccctggctctccagcctgacatcctgctctgggagatttggacttgccagtcgcaacagctgcatgagctaggtcttcaaaaccgctcccccgtctctctctctctctctctccacacacacacacacacacacccagaggaaccctaacaaatagggtgcttatatctgggacccttgaagggcataactgagatcagtactgaaggttggtctcactctgctgcatggcttctaaggcagaggcctgttgcgttcccctcccaccctctgcagactgacatccatgtggctcatcactgtgactcagggtttggtcatccaaccatgcagaggtcactacaattccacaagtgttccctgccctccttctgcctatgaggtcctctgtcccatcctgaggacacagagatctactgggtatgtttccagtcttccaggaaggagccaggagcctggtgagggagatacacctgcagcagcagtaacagcaaggggcatagccagtgtgttcacaaactcatgagagatcacattaccaacatctcccacttaagtttccccatcaactaacagcttatcctgaaattatcatgttcgtaggtaagttggattccccttattctattggcccccaatatgcacagatacaaaaaaactgatactggaatattctgtcagagtgaaatccaagaatggaatgccttgctgtgatgtgattttcgaagcaatcaataaggctttataagttcccagatgaagcaacatacaggcctccctcagtttaaagggagtgacatgtatgggaaatccagtttattgaagactctggaaaaagacgtttgcctgcctgtaacactcagtacccaaatgcaagtagcacctgccaatcattccaaaaactgcagctgccctcagaaatttctaaaatgccccaaagtggccgaagatattctggctataaaccacaagtttaggattgaaaagaagtatcctcaaacttcttatttacatcaaaagaataggaatgttgccgttggtacagagaaaatagcagggtagcgtggagaaggacacaatgttccccaggagggtttgcaggcaccttcctcctctgtcctgctttctgtgataagaaagtcgttcagggataggtgaggtggctcctacctctaatagaggttgaggagtgagtattgcttgaacccaggagtgtgagatcagcctgggcaacataaggacaccccacctctacaaaaaaaaaattggccgtgggcggtggagcctccatgtagtgaaactacttgggaggctgagatggaaggatcacttcagcctgggaggttagggctgcactgagtcatgatttttccactgcattccaggctgagtgacagacccggtctgaaacagcaacaacaagtggtttggggccagctggggtgtgccgggaagcttatcctggaaaagatactgttgctaggtaagttggattcccttcatttttaccccaggcatgcagagctactaagcaaactgatactggaatgttgtgtcagggtgggatccaagaatggaatggcctgcagtgatgtgattttccaaagcagtcaataagtctttcataactttccagatgaagcaacataccagcctccctcagtttgcaggggagtgacatgtatggaaaatctagtttacttaaaactctggaaaatgatctttgcctccctgtaacgctcagtccccaaatgccagtagctcctacccatcattccaacaaccacagctgcactcggaaacaaccaaaatgtttcaaagtagacaatgatattctggctataaaccatgagtttaggattgaaaagaagtatcctcacacttcttatttacatcaaaagagtaggaatattgcggccagtacagaggaaataacaaggcaccaaggaggaggacacaatgttctccaggaggggttacaggcaactccctcctctgtcttgctttgcttttagtgacaagaaagtggttcagggataggcatggtgtctcaagccagcctggggaacatagggagaccaccatattaaagaaatttaaaaaaaacagccaggcgtggtggagcatgcctgtagtctcagctactttggaggctgaggtggaagcatcacttgagcctaggagtgagccatgattgctctactgcaccgcaggctgagaaagagagtgggaccccatttcaaacaaaacaaaaataagagaaagtgtttcagggccagctggggtctgtggtgaagcttcatttcaaaagtcaatcactgctattggacattgatgctcaggatgtttccttggtagtcatagttctgagatcccaggactgatgtccttctcggcaaggacagccctctccaggctggggcacaggaggaaggtgccaggctaggttgtcaagctaccatggacagctgtctgctgtagaatcacagatgagaacaggaaaagaacagctgaaaggaggagaagggagacaacttctgcagttgaggagcaggtgcctgttagtgaagggaagacattggccctaagtcctgacattgctctaggctcccatggaaggacatgatggtgccaagcagaatccaaggctggtgggaggagcagaatagctgggaacacctcccacctatgcgttcaatggtccctgagaggagcccatgccattttggaatctgaaaggttattttttgacattccctccattcaccgcccatgaagagaagggatttgagataaactgaggccttcagggagaaaggccagatggagttgtgaggccttctcaaaagtctgtctgccccacccttatggtgagtctcactgcgctcatcttgtcctgtgttcctctttgctctgatgtcgatctcctcaacctcatgtctgtcctgggaagagtaggtatattgcagacagtcttgctacctaagcaatttaataaggtttctgaaagttcccaagcctgagcagtaaattccaagatcctaggacaccattgtggccacgctacatgagattcgccaggtgtgaatcgtggaatcttcattttaaaggatcctggcttgcaaccttaatggaaacttgtctgagaactagtagcagagcagaataatctgctttcccagcaagacagcttctttctcctttgtgaaggtatagaagggacaggtttggtgtgttctctgatgtacaaatccaagaccttcaggtgaggagaccgacactgacgtgctgcctgttatggtaatgacacactcagggcaccatctccaaatgatacccaggccgatcctttcaagtctccatctcttaactatttccgaagaaatcgaatgtctcttgcctgtgcagtctcatgctatgaaatcctaaatattttgcaatagcctttggaccttactcttgattccacaaatatgcagcacagtagagttttacatgatgtctctgacctgtggctccagcactcactgctgggtgacactgagaaagttacttaacatctctgtgattcctttctccattagtaccattgaaatactactagtaattgcatctacttcttggggcagtttagatcactgactgtgtgaagacatgcacagttgtcaggactgtccctggcacattgtcagtttccaatgatttctagctgttactgttttgctgtttatattgttgttgttcccacatttccctggagcatgttccagagatacaatgtcacgactacctttgaccccttcgatgatcttttgattatcactttatttcctcagggactcaaggactgagtctgtggggcagggcgaggccatatttttaagagcataatgaatattcagctctccttacagggtattgtggagcctaaatgtaatgctgggatttcatcatcatgagcttgcacgaaaaattcgaatggaaatttttctaggaaatcggaacactaatgacctcttcatgtgatttgtataatgcttggaaaagtaactagtgactggatagggatagcacataaggatataaatatttaaaagattatgaattttctatttcttagtttctgctttttgtatcctatctgtctttgttttacacgatgccacaggttctcttacattttcttctagaagtgtcaaaactttagcttttacattaagttctataatgcattttgaggtaacttttttatatcgtgtgagataaaggttgaggttcacttatttgcatgtcaatgtccaattattccaccatcattctctgaatacaacatcctttcccactaaattatcttggcaccttatggaaaaaatcaatttaacgtgactatataggtctagctttggccccttatttcttttcatatgccgatatcacactgtcctaattaccacagttatgaaatacgtcttgaaaacaggtactgagtcctccaataattttgttctttataaaattgttagactattctagtccctttgcttttccatatagattttaaggccagcttatcagtttgtagaaacaaaaggcttcaaggattttgattgtgtttacattgaatgtatagttcatttgggagtaactaacttattcacaatcttgagtgttgcaatccattaacgtggtatacctttccattaatttcagcctgctttaatatttcacagcaatgttttttaggcttctgagtatagtttgtgtgcatattttgttaaattttaccagtaaatatttcatggatttttgctgctatattaagtggtaatgattttcaattttcaattatttgttgatgatatttaaaaatcacattgacttttgcatacttatcttgtaccatattactttgctaaactcacatatgtatatatattcaagtcatgggatgaatctcatttggccatgatgttgtatatttttaatacattcttagttctgaactgctattattatagcatatatatatatctatgcttttatgaacatgagttatattagtctgtcatgttattttctcataatgtttgtatggttttgatataaggctgatgtgggctctgtaaaatgctttgaaaagtgtgatctctttcaattatcataaagggtttgtgtagaattgatactatttcttccacaaatgtttgcagaattaaccagtgaaatcaccagaaacatgaattttatttgagaaaaaaattttgtttcatttctttgttggttttagtgaattcaatttctttaattggtataaacactatatatgtcatctatttctttggggggaatgaggtttgctagctagtgtccttcaaggaatcttcccactccatttaaaaaataatattttggatagtgcttttcaccatgttccctatcatatatttaatatctgaatgatttgtattgatgtgccctctggcgctactgatatctgtgatttgtattctctctccacttctctcatcagtctgtctaaaggtttattaatttgactgttcctcccaaacaagcgacttctggtttcactgatttttttaatagattttttcatttctatttaatttatttctattcatatctttattaatttttccttcttgttgttttgggtataatttgattttatttttccagtttcttattttatttatttgtttaggttttttttttttttcatagacagtctggcactgtcacctagactggagtgcagtggcacgaccttagctcactgcaacctccacctactgggctcaagagattctcctgcctcagccactatgcccagctaattttttttttttttttttttttttgagacagagtctcactccttcacccaggctggagtgcaatggcacgatcttggctcactgcaacctccgcctcctcagttcaagcgattttgctgcctcagccacttgagtagctgggattacaggtgcgtgcccccacacccagctaatttttgtatttttagtagagccagggtttcaccatgttggtcaggctggtcttgaactcctgaccttgtgatctgcctgcctcggcctaccaaagtactgggattacaggcgtgagccaccatgcccggccaactgtttttctagtttcttaatgtggaagcttaggtaattgacttgagacatttcttcctttctgatataagtattgaatgctataaatttccctctgtgcactgctttactgtgttatcttgcattttttgataggctgtgttttcattttcaaattttctctacaatttattctttcatccctgcgttacttaaaagtgtcgtttaatttccaatatttcagggattccgtatatctttctacaactaatttctatttcaattcttttgtggtcacaaaacatgttttgtaagatttcattcctttagaatttgttgagatttgttttttggcccataaataaggtctatctcggtgaacattccatgtgcacttgtgaagaatgtatattctgttgttgttctataaataacaattaggccgagttggttgataccattgttcaagccttctgcatatatatatatatatatcctgattttcttgtacactgtttctaccaattgctgagagaaatgttgaaatctcctactataagtgcagatgtgtttgtatcttctttctcatgtatgggtgttcccctcatgtattttgaatataatatgatatataattaaatacacctaatgtatttaattattttttcagatgcagggtgttactgtgttgctcaggctgctttcaaacacatgggctcaagtgattttcccattttggccaatttttatacatgctttgattaatcacttccttatctggttctgggttttcaaccatgtgtacaatgaatttaactacttctgtagactcaatcaattcacacctctacccttttttttaggttgtgttattacacatttaaatctctcgactggtaactaatttccctgaatacctataaggtgatcatgggctcagcagtcagtgtgatttcaacgttggctcacaacagcttggaaagcctgcatgggaagtattgcttgaggaaaagtggagagtttccaggaacagttttgaaaaacaaagacaaccgatgtcatccttccctcccttgcctctcctcatgtgccaggttttctgtttcctccagctgatagaaaatcagcatgaagtattctgtgatgaaaagtttttatccctttaatcatcccgtttcttcctccaaaccttttattctttctggaagggtggtatgcagaaggaacaaaagcattttcagaaaaacacattataatataaatttagtgaaaagattcatcatgtttaagaaatggtcaggatgaaatcctgaatttgtaaaaattgtaaaaatcagtttacataacctccatcccttttgtctctatcacttatccagtgagaagtgtagaaaagatgaattccttatttgtggctgctgcgttgagtagccaaactgctggccaccttccatcaatatcatatatccagatgtaatagccacaaaatgcaaggcctgtttaaaactttccctgatttcatccatctcattgaaatttccatcaaactcctagcagtaaattcagcattcaaagagttacaagtactgtggctaagagagatcctggctcaaatgttgggagggggctgtagcagtgggcgcccagctgaagacaaggctggaatgtgtcttcacaaccccccccaccctttttcagacaggatttctctctgttgcccaggctggagtacactggaggactcacaactcactacgacatgaaactcctgagctaaagtgatcctcctgccttaccttcctgaatagatgggactacaggcatgtgtcaccatgcccagctaattttttaaattgtgtagagcaagagtctcactatgctgtccaggctggtcttgaactcctggcctcaagtgattctcctgcctcagcctccaataatgctggaattcctggtgtgagccagtgcatgcagccacttttacccgccttttaaaatctaaggcttaagggttttctgaggctttgctccaacccaggaagctgataattttcctcccacttggatgaaagagcaattcaaatgttcaggatttttggcctgtgcaaagctctttggcaattattgagtcctttgtctacctgcctgcaggagaaaacaaaaattaacattagcatgaggctgcacctttcccccatatattatctggagcagaacagtggttaagggatccagggatccagctctcttgcagttggagggactattgttaaatgctgtgagtacatgtatttttcataatagacaacagcttcggctgctgcttcatattatgggtaaatccatggtctcccaggcatgacagcttcatcatgtctaccccttcactcttcctttattcaaacaaggctttcaccatattgtatgcagttcctaatgtgacattaactgatttctccaaagatacttttcagggtatttccaggagcctattaggcatccagaccgtagtttgaagccaaaacattaaaagcaagtttacagaaaaagtacacattatttgtaaattcctttagtttcttaggtattttgtgtggtgctgatattttgagtaaaactatgcacatgttcggaccttggactatcttttggtttccttgcaggactagaaagcagggtgtgttttaaaaatgtttttaatgcatatgcttggatgtttatcgtcgaagtctctacagaggtctacctcaatgtaagcaaaagggtgactcttagacttctggtttttgtccactgtataaaactaagattttggtgtccttcccatatctttaatttcatctgaatataattcccctagtaatgttcccaacttttatgtttctattataggagaaaggcaaccacagttttaaacgaagacaagctgaaacaacacaaactggttttatattagagatatttgaattaaaaatatttcaataaagttttgcaactttcaccaaaaaagtcttgcacatcttttgttcattttattcccaggtatttgatactattgaaaactgtggcttgatgtggtagctcaagcctctaatcccagcactttgggatgctgaggcaggaggactgattgagcacaggagatgagaccaacctggccaacagaaagagacccccttttttaaaaaataaaagaataaatacatgaatgtatgcatatatgtatgtagctgtagtcccaggtactctggagactaaggtgggaatgtatgcatatatgtatgtagctgtagtcccagctaatctggaggttaaggtgggacctcttgggcccccaagaggtccaggatgtggttaaattattttggaatggagactcaatttcaaaaaaaattaagaatcatttttgaaattttgtattgtgattgagctggtatgcacaggtgtgatattgtgaaacacatatttggttctagaccctgcttccaggcatacaacgcctacaatttttagaatctccacaaagtggtgtctttttgtatgctagtgaattgactgatggctagcagcacctaggtagctctaggttggggaagaagagagttgggcctttcagccccacccacaaccttcagggaagggacaagggctgaaggttaagttgatcacaaatggcgggccaacagtttaatcaatgacacctacataatgaaaaccgaaaaggacatggttcagagagcttccctctagctgaacacatggagggcagcttgcgcatagagggcatggaagctccctgccccttcccccgtacctcaccttatgtgtctcctcatctgcttcctttgttacgatatccaatttgccacaaaatatgtaagaagttcctaggctgtagaactggatggaagaattagggcttaggtagaagaaaggggaaagcaaccagagcaacttgctgaagcaagatgacttgggtcctacctacactgtctctttagaggctatggcatgaattagccatgggtttccatcctgcctcccacacactggccttgagatggtgggcaagatacttgcaatatttgggaccatttcctcatttctaaagtagaaattacaatagttacactaattacttgctatgaagaatcaatgaaataacataccaagtaggcattgctttgcagttaaatttggtttactagatttccttgtttcctttaagatttcaaactttttccttccatatttctttaaaactacatctcttgtatgtgatatctgcttttgaatttcaagtaggaatgtcaagttaccttttaaaatgcatttgacttcacaaaattatttgatttcaatgaatatgttaatgaattagcagtgtagctggtgtcagacacgggatcgattctaaagtggatttctaaaaaactgaggtgtgacaaggccaaacctaagtcaattgtccgtgcagaaaacttgtttgctgtgtgcgatgccatgaagaataaatcaatattctgggcatgcaatgccacacaactcaatacagtagtgtgtcaagtgctcaagcagtccctaagcagccctggccacaaggatcaccactgcagttgttagtttgccgtgtaacatattcatagatttggtcaataaggagataatgagcccaaatggatccaagtagttgattgtttgcagacacaacaaaagcaagagcagcattgtgtaggcaccgtgtccctagtcccataatacaacactgaatagcaggtactcagtgacagacagcacagatggtgggtctctctgcctgtgaggagctcacagccataccctaaagcagtgagcagttttataacaagttaggataacagctgtaccctaagttgtggaaaaggcctgtggttttctgaaactagagcaatggatgaaaatggactccaatgaagtgaagttgtataagttcatgaagttttgctgtgaagggcagcagataaatgtgttagtagctacagaaggacatgggggaataaggtgagttcctccttagcttggggaataatccagtatagagggagccgttgatggttcaggggcagaagtgatcattgcaggatcaaagcccctgggaaagtggaagttatgtgatcctgagctgaggtgaggggctggcttcagtcaggagcaattgcatgcagaagggccgcagagaatgccagaacagcacaggtagactgggtttgggaagctctaagagttcccagcagattgcttctgtcttctgaatgaatcattaggagaggtcattcaaatggaggagggttcctggcattttgtgagagtattgtagtagtggaagtaggaagagcatgaaagggagaaaattctctcgtggtcatggacttaaggtaaaataattcagaaggttttgaagttttcttatcactgctcagttgctcagatacaggcatcattatgcggtcattaaattagtaggaggagcagtagtgctagttcataaaatagatatgataatgctcacctcctgaggggcactaaaaggatttttattcgtttgttagggctgccatcaataactaccaccgactgggtggcttaaacaacagaaatgtattttctcacaattctggaggctacatgtctgagatcaaggtgtcagcagagttggtttcttctaaggcgtccttccttgccttgtagtcagctgttttctccctgtgtctgccttagtcctccctctgtacgtgtgtctgtgtcctcatttcctcttcttataagggcactgggcaaattgccttagggcccagtctaatgacctaatttctcttaattacctctttaaagaccccacctatgtcacatacagttacattcttaggcactaggggttaagacttcgccatatgaattttgagcagacacaattcagcccataatagtattgctgttagctttatcttaataccgttttttatttctgagacagggtctcattctgttgcccaggttggagcgcagtgatgttaatgtgggttactgcagcctgcaactcctgggctccaggggatcctgccatgtcaccctccctattagctggtagtacaggcatgtaacagcacaccaggctaatggtttaattttttttttttttttgacatgggacatcccactatttttcccaggctggtctggaactcctgtgctcaagtgatccttctgcctcggcctcccaaagtgctgggattacaagcatgaaccaacaagcccagccttattttaatactatcttcactactattgtcactatcatttattttattcttacaattacctggaaaggtaggaagtagtcactgaagctcacaaagttcatctattgctgaacctcaccaggaaaggaagtactagtcaaacagacaaacctcatgtgttttcaagtggagtgtaactgagaaagtcagatttgttagatttcttatcatgaatttatttgttattgttaaattttacatgctcagcatcagtaaagaaaagagtaatgaaaaatcattaagcccagagataaatccacacacttacgctctattgatttttgacaaagatgccaagcacagacagtggggggagggcagctttcaataaatggtattggagaaattgtacatccacacgcagatgaatgaaatttgaccctcatctctcaccatatacaaatcataaacagagggaggctggtatgttgcttcatctgggaacttataaagatttattgactgctttggaaaattacatcactgcagggcattccattcctggattctgctctgacacaacagtccaatatcagtttactttgtcgttgtgcatgcctgggggaaagaatgatgggaatccaacttccctaccaacatgaccttttccaggatcagcttcactgtattccttgtttttaaaaaattaagtgttttctactttgatggagaaaattttaatctcaattttgccttatttttcattctaaaattactagattgcataattatttccatagctttgtactttgaattgttttagtactaattttttattttattgtgttatttattcatcttgttacttatgtagtgctttaaatttatttttcacttcaagagtttttttgtctgtgtgaagaatatcaactctacatattatataaagactaatttttctgtatatatattgttcgaaggttgttgacttactattttttcttttttaaaacctgtttaattaacaactattatatgtatttatggggtacaatgtgatgttttgatatatgtatacaacttaagagttgcatcagttataaaaggtactggatagaagtgcaacacattgtttacctcagactggagaaattgtggttgttagtgtttattctgctattccatattttacaagtttctataaaaagcatctactacttttttaatcagaaaagaaatattattttacatcaggaaaatcaatattaaattccctcagagagaatatactatcacaaatctttgataaaataaatagcagtgtgctatcttgaatacattttcttggcctattagctggggttctctagagggtcagaactaataagagatatatatatatatagctcctatatatatatgtatatatatatatctcctatatatgtgtgtgcgtatatatgtacatacacatatgtatccacatatatacatatatatacatatatatatatgagtttattaagtattaactcacaagatcacaaggtcccacaataggccatctgcaagtggaggagcaaggaaagccagtctgagtcccaaaactgaagaacttggagtccaatgttcaagggcaggaagattccagcatgagagaaaggtgtaggctgggaggctagactgctctagccttttcacatttttctgcctgctttatattctagccgcactgacaactgattaggtggtacccacccagattaagggtgggtctgcctttcccagcccacttactcaaatgttaatctcctttggcaacaccctcacagacacacccaggatcaataattttcatccttcaatccaatcaacttgacactcactattaaggtcacacttggttatgtcagttttcctttttaggtatcatttaggggtggaggatagagaggaccttagtttccatttttcttggtgaaagttaatgaatgctgctttctgtgaaagaaagaaggctacaatatttgctgtaatagtatttcacgacatcaataccatctttatctttatttctttcatcattacagcaaagggaaataatcatggtgctcagtcatcagacaagaagcaaaagtccatcaatgtgaatgccagaggatatctttgcttcttagagtagccgtttagcagtctgtcatctgtaaatttaccttagcctcttccaaatatttcctcatctatcatcatttaggggttcagaaagtggctattttcgtattttttttgtccaaaacttacttaggttggctcctttactaactcccaatcttctccactataatgactctggaaccagtccctttgctgtgaaagcagcatcaacaacattgattcttctacctcagacccactggataacataattaatgaaatttttaaacttaaaattggaatgaaaacaccatagaattagcaatggctaaattatgtaactccaagcagttaacaattaagagaaactttgtccctcaaaaagtgaacattactttcttctttttgatttttctcagaattttttctgaactgaaaatgtaacaaattcataaaggccaaacacaggcaaattttctattttttaatttttaatttttatgagtacatagtaaggtgtatatatttatggggtatatgagatattttgaaacaggcatacaatgcataataatcccatcagggcaaatgaggaatctatcccctcatgtactttgatttttaatccaaaatgttaattctgcctttaagtttttttctttttttagcatccatttttttttaagacagtctcactctactgcctgggctggagttcagtggcgcaatcagctcactgaaacatctgcctcccacgctcaagtaattctcctgcctcagcctcctgagtagctgggattacaggcacttgcctccagtcctggataatttttgtatttttagtagagacgaggtttcaccattttggccaggctgatctcgaactcttgacctcaagtggcctgcctgcctcggcctcccaaagtgctgggattacaggtgtgagccaccgtgcccagccagcatccatctttttaatgactattttagtcttaaaaacaataaatttctccggacgcaattcctttgaaaaaaattatgacaacattaaattgaattatgcaattttaaaaattataatgataaatttacatgtctctgggctgggtttgatggttcacacttgtttttgttttgttttgttttgatggttcacactggtaatcccagttcccatgggaggtcgaggtaggaggatcacttgtgcccaggagctcaaggctacagtgaagtagcaacacaccactgcagtgcagcctatgtgacaaagccagaccctgtctcaaaaacaaagaaagaaaaactttaattaatttatatgtgtccttaaccaaattgcatatcctttgagggaagaggctattgagcatccttttgcctccccgtaacttctaacacctaaacttataatgatggatcaattctccaaaggaaagaatatagagcaaagctaaggaatacatgaaaactgacagagagaagcaaggacaataaaattgaggaatataaatccggaaagagaactgaagtattatggcatccccaaaatagacatgtgacccaaaggaacagaatagagagcccagaagtaaatccatgcacttacggtcaattggtttttgacagaggtgccaagaacacacagtaagggaagggcagccttcaataaattgtatttggaaaatgatatatccacatgcagaggactgaaattccatcctcatctctcaccatatacaaaagtcaacttaaaatgaattaacattgtataatgtaagacctgaatctatgaaactactagaagaaaacatagggagaaagctccatgacgctggtctgggcaattagtttttggatataatccccaaagtgcagggaacaaaagcaaaagtaaacgaatgagattatctcaaactcagaaacttctgcagagcaaaggaaacaatcaacagtgtgcaaagacaacctatggaatgagagaatacatttgcaaaccatacatctgagaaggggtgaagacctaaaatatataaggaactcaacagtaagaaaacaaataatctgattaaaacctgagcaaaaagcccggcacagtggctcacacctgtactcccagcactttgggaggccaggtcagaggattgcttgaggccaggagtttgagaccagtcctggcaacatagtgagaccttgattctacaaaaaaataaaaataaattagctggggtaacaaggcagccatgggaactgataccaagggtggctagtctctctgaggggagatgagacacacaaactgcatcacctctggcagagcacatgtggaagaagtgacagtcataagaggggataagaaggaagtaattgaaaatgtaacaaattcataaaggccaaacacaggcaattgggagagctggaatcccagaaagtctcagacacaagtggaatccacattcacttgccagctttttcctgcacaccaccatctggcattcatgaggaagactggaggaatccacggaggcctgggggcatcttcgttggcaagaaaccctgattgcttcgaaaaccttgtccctttaaaaaaaaaatcattgtgtatatttgaggtttacaacatgatggtatgggttacataaagatagtaatgtggctaatgtagtgaaggaaattaacctattatatcatctcacagtgacttttgtgtgacaagaacagctaaaatctacttatttaatcaaagtgcctaatataatagcaacaatcttcatgttgtaccttagctctctagacttgttcatcctacatacctgctactttgtatccttggaccttcatctccccatttcctcctctatcctcccctgtccctgatcaccaccaatttattctctatctccctattgcttgctctttcttctatctccctattgcttgccctttctttctttctttttctctctttctttcttcttccttcctttccttctttctttccttctttctttccttttttccctttctcattctctttctttctccccccacctttctttctgattccacacataagtgagatcatacagtacttttctttctatacatgtgccatgttggtgtgctgcacccattaggtatatctcctaatgctatccctccccgctcccccgaccccacaacagtcgccggtgtgtgatgttccccttcctgtgtccatgtgttctcattgttcaattcccacctatgagtaagaacatgcaatatttggttttttgtccttgtgatagtttgctgagaatgatggtttccagcttcatccatgtccctacaaaggacatgaactcatcattttttatggctgcatagtattccatggtgtatatttgccacattttcttaatccagtctatcgttgttggacatttgggttggttccaagtctttgctattatgaatagtgccgcaataaacatatgtgtgtgtgtgtctttgtagcagcataatttataatcctttgggtatatacccagtaatgggatgggtgggtcaaatggtatttctagttctagatccctgaggaatcgccacactgacttccacaacggttaaaccagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttgtttttttcctgtaaatttgtttgagttcattgtagattctggatattagccctttgtcagatgagtagattgcaaaaattttctcccattttgtaggttgcctgtttactctgatggtggtttcttttgctgtgcagaagctcttgagtttaattagatcccatttgtcaattttggcttttgttgccattgcttttggtgttttagacatgaagtccttgcccatgcctatgtcctgaatggtattgcctaggttttcttccaggatttttatgtttttaggtctaacatttaagtctttaatccatcttgaattgatttttgtataagttgtaaggaagggatccagtttcagctttctacatatggctagccagttttcccagcaccatttattaaatagggagtcctttcctcattgcttgtttttgtcaggtttgtcaaagaccagacagttgtggatatgtggcattatttctgagggctctgttctgttccattggtctatatctctgttttggtaagagtaccatgctgttttggttactgtatccttgtagtatagtttgaagtcaggtagtgtgatgcccccagctttgttcttttggcttaggattgacttggcaatgcgggctcttttttagttccatatgaactttaaagtagttttttccaattctgtgaagaaaatcattggtagcttgatggggatggcattgaatctctaaattaccttgggcagtatggccattttcatgacattgattcttcctacccatgagcatggaatgttcttccatttgtttgtatcctcttttatttcattgagcaatggtttgtagttctccctgaagaggtccttcacgtcccttgtaagttggattcctaggtattttattctctttgaagcaactgtgaatagttcactcatgatttggctctctgtttgtctgttattgttgtataagaatgcttgtgatgtttgcacattgattttgtatcttgagactgctgaagttgcttatcagcttaaggagattttgggctgagacgatggggttttctagatatacaatcatgtcatctgcaaacagggacaatttgacttcctcttttcctaattgaataccctttatgtctttctgccgcctgattgccctggccagaacttccaacactatgttgaataggagtggtgagagagggcatccctgtcttgtgccagttttcaaagggaatgcttccagtttttgtccattcagtatgatattggctgtgggtttgtcatttggcactttttactgaacagtggataggccttttaagcagttcctagaatcaataataaagttatgttcaacttttatcttcccaggcaagagattcttgtagtaataatgttatgttaatgaagccagtggaatagtaaactcttgttcatataggcagtaagctgtgtgtgtggtttcagttctcattacttacttttagataacttatgagcgtggtaggtcatataggaaagggaaggagaggaagggggccttgattagctagttgctttttgttagtaaatgaggacatatgtgtgtgtgtgtgtgtgtgtacatatatcctattcatacataataattgtacatatttacagggtacagtgagatattttgatacacatacacaacttgtaatgatcaaatcaggataatcagcatatccaccacctcaaacatttagcatttctttgtgttggaaatgttcaaaatcctcttttatagctatttgaaaatatacaatagattattgttaactatagtcaccctacagtgctaaatagacgactagagattattcctcctatttagtcttaattttgtatccattagctaaactctacctgttcatctcccacccttcccagagtctactattctctattctgctctctacatctatgaaataaaagcttttagcttccacatatcaatgagaatattcagtatttatctttctgtgtctggcttatttcacttaatgtcctccaggctcacacatctgaagcccatacatgttgcctcaaatgatgggatttcattcttttatatgactgaatagtattccattgtgtatacatacaccaatgtaaattagattgtattttgtttacttatttcttttttattgatacattgttgtacatatttatggggtacatgtgacactttgatatatgtatacaaaggacaatgactaaatcagggtatttaggatatccatcacctcaaacatttatcatttatttgtgctgggaacatttcaaatcttcccttctagccattttgaaatatatgataatttattgttaccattagtcaccctactgtgctatcaaatagaagttattccttttacttaattgtatgtacccattaaccaacttcgcttcatcccacccaccccctgttcccagcctctggtcaccaaaattctactccattagatcaaaatttttagctcccacatatgacagacaacatgtctcgaactcctgagttaaagcgatcctcctgcctctgctttccaaagtgttgagattatacatgtgaaccaccgatcacagcttctgttttcttttaagatgtacattaaactcacatttgtgagttttctccttcagtcagaagaggaacactgactctttcatctgccccttggaggtaaatttttctttttaaataaactatgactccattgaaattcttatttcaaccaagtttatgaagcactgtctcatttaaattatcagggctatattatgcgaagatttagaagatttgaagctcctccaaccccaaatcaactgaaccttacttggtgacctgaaccctcacctctcttctgattaggctatttctgctttggttgaagatgttcatggatcctgcaaggaaaattcaatttccctaatgtcttgacatttcctataatcaccaaacctgtaactatagtggatcctactcaggataaatgtggttttaagtttatatcctgtcgtaggttattatataaaaaataactacagggatttgctaattatatctccattgtctaggtaatatacttgggagaggaaaaaaagcattgcttctcttgttttttgagtgctggccttcctccctctggctccccttgagcaagggatgaagccatttctggggtttggcaagttagccttatgggcagggcatgtggctatttgctcatgggatgtgacactccagtagggttgattttagctggagtctgggaagaccattttataagggaatctctgttgcagattcagttttaaggagagcttcttccactgtggagggcataacagggtaattggctctactccagtaagggcttcagttttaattaaatggtcatataagttttaaggtatcacgatcatgattgatattaaaatgtgaaagagttatacatcatatccagtatggcaaaaaaaaatgaagagggaaagaaaactgagagtaaggcatctggaaaagctaaatatttgcttctaaaagtaactgttttgagggacgaacagcaaatttcacaagctcatgcacagtctttgtgatgttcagatattcaggtattaaaggtatatgttaaataatgtaggtgttcctagtatgtgaaccatttcatccatactctgaaaatattagtgttcaagaatgtattccctttcaatcatgccttatattcaatatctgtgtcttgttcatattccgtgttgtgctttttccattttcctcaagaatgtttaagctactggatgctctcttcctagatatttcacaaaagaacgatctattaaatttattacatttggattacttttcctttggttaatgattcgtacctttcatttactgcctgtttccttttcccttaagtttctcttgtgactcttttttttatttctaagtattattttcttgtatcatgtaatttgctgtctattttaataggatacgcatataatgctatgactgtcctaagaatacaattcaggcttgttcaataggctcctggaaatcgtctgtaaactatcctttaatgtaaatagtcgaatggaatggttcagcagtgtggagtaaaaacatttagataatttcttccctatacgtgcagtgcttcctttaaattcagaagttcttctaattaagtcagcaatttggaaaacatgtatgaaaaatacttatgtggactactcaggacttagtacattatagactttgaactctaaatcatatcatctgatgactcaaggcagaagcctgtaatataacctctgatatggttagaggttaccatatgtgtcttcaatctaattacacacagtagctcatgaagactgacaggaggacagggagcatgcttagcacaggcatcttacaaccaccttgagcatgactgacctacatgcattctccctacttcatgggtcacaaaaacctgactgtctctatcgattttattactcagtcattcaaggcttcactgcgggaagactttaaaatgtaatcattgggtctggcgcaggaggaggttcacccctgtaatcactcccaacattttgggaggccgagacgagtgggtcacttgaggtcaggagttcgagcccagcctggccaacatggtgaaacctcgtctctactaaaaataaaaaaactggttggcatggtggcaggcacctgtaatcccaaatacacgggaggctaaggcatgagaattgcttgaatccgggaggcagaagtcgcagtgaaccgagatcggaacactgcactccatcctgggtgacagagtgagaccccatctgaaaaaaaaaatgcaatcattgtttaagagcctgagagaattcaggatttgacaaaatccaaaaacactcatgaaggtctccatacaggaaaacaagcatcaagcagagtgccttctcattttcttaggagcaatgaaatctcaactcagatattttaattggactaaagctgattgttatgatgaaaaaatcatgaaaatcagaatatctgtgtattctctccaacagaaccatagcatgcagaaatcagcactgaaatggattttaatctatttgatatgcattcactactttcaataaaagcaaaaatgggtgtaggattgatgtgatttgtccagaatctcacaaatcgtgttggagctggtactagaatctccttcagagatcagtatatttcatacaaagtggtattacaaatgcattatatatttgtgagaaacagaaattacaaagtaatctgaaaattgttagctgttggttatacttagaagtaacaaaatgctttcctatttgatggttcaatatggctttcacccaatttgtgtctgtatctgatagtgtttcggctttgcagtcaggcttctggggtctgaaccaccttacaaataaagtctgcatttgaattctgtttttaaaggggcagtaatattctctctttttattatgaaaagtgtaatattgtggaatacagaaagcacataattttgaatcttaatggataacatacctccttctggcattttaaattgctctgactttgtcagaatcttcccctggacatcaggaccatctccgcattcatccccagtctttgactgagacagctcctggagatcagcttccaggtcaggcactaaaaaataccaaggaaatcgattggagcagccagacaagaatgataaataaggaaatgatcctattcttttcctcagtgttgtgcaataaaagcctgtaggctactgtggtaataaatgtgatgcaaagatgtccccgtttgttttcctgtattatgatatcttatttttaatgacaatctgaggataagtctcagcacacctgcatttcccatactttaccattgtgtattataaacacacagctacctaggaaacctgaagatggcctcgtggatagcattttaatcataacttaaatgtaattttctgaaggattagatcaatgtattggtgagcctatgacaaatcctatagtcttgacactcatctcctgttgaggtatcttgaaaatgttgttgttaaccttaattaaagtaattattaggttgaaaggccctatatgtgactttccatacatgaatgtcattaagaaaaaatacaaaatataacagcaaaatcactgtcttccagtgagagtatgggaactgaagtgcaaagaaattaatgggcattgttgacagtcatattctggaaaccccttaacagggaattgctaaaataatccatggcccaaattctgtctctgattagtctgaaaatgctatctgttgaggaaacagtttctgtttcatgataatcttatcgtacttgaagttttctaattataaaaatattagaacaacttttaaaagccccttcaaaatcctacaaacacagttacctgtatgccattgtcctgaattatccagcttttactaaacatatggtcaaaaatataaatcaaaggaaacagtggctgtcatccattggcctcttttctggagttgctatcttgcttcactgaactgcgttttgccctgagccaataccaaattaccttatagtacagacacatttaagtattaagcatttttaagcaaaatcattcacattttctaaaacagaaggcgggaagaatgcaaaccttgaaacaaaatatgaattccttctccatgagtcgtgttcttggtaagtctcaacctctgattctcagttttcttatttatttttttatttttatttttatttttcaagacggagtctcgctgtgtcaccgaggttggagtgcggtggtgcaatcttggctcactgcaaccaatgccacccgggctcaagcaactcttctgctgcagcctgcttagcagctgggattatgagtgtgtgccaccatgcccagctaatttttgtatttttcgtagagacagggtttcactatgttggccaggctggtctcgaactcctgacctcaagtgatccacccgcctcggcctcccaaagcacagggattacaggcatgagccaccacaccgggcctcagttttatttataaaatgaggttaacatccctttgcaaatgggctttattcagggtattataaggtagggcgacttggcactccacatgctattaaagggtgcttaaaacactgtgaacaccatggctgagaagatctcactgcaacatcctaagaatatcaagttaaactagtgaaataatgtacatttttatacaaccaattaaatggtttcatctgatttaggaaggactgtattttcaagcccacaaaatgcatctcgaagaaaaagagaagattaatcatatccagggactgcaggaagctgcaaactatacccgtcacgtttccagccaaccctcagcaaatgtttgagatcctttcctagtgttttctttcctcctcttactggtcatggcataaggcatgatgcacacataggtctcctcccccccatagacattctttctttcccttcccaccaccttgaatctcagctgcaccctgatcttcttctgtcttctgaccaggtgtacgatcccaactttaagctggtggttcttcttgttgaggctctggcacactgggctcctgggaaaagagggttttgtgtgtgcgcgtgcagataaaaaatttttcttatcaatgcatgtcaataatacgaatatacagattacatagatacttctgatcatatgcatgtttaaagacatgctgcaacactagctatgtgctagtgtaatgagctatgaataagcatgaggaggaaatcactagtcaaatctggggaacacaaattcccacatccaggaaaaaccagtatgtagtcctcttgggttactgtttccttcatgagatgccgcaatggttttttgtcaacatgggagacctttatcattgcatctatactaattcaacaacactatcacacaaaaaaaattctgctaatagaaaacatcaaatgttaagtcactcacaagcataggcccaatcagctgagcaagtcgtaaacatcgtcttggtctatatcatcttcctcgccaactcatatttcagtctgcaaacagaatagtgtgcactttgggaggccgaggtgggtggatcacctgaggtcaggagttcaaggccagcttggccaaaatggtgaaacatcgtctctactaacaatacaaaaacttagctgggcatggtgcgggtacttgcaatcccagctaatcaggaggctgaggcaggagaatcgatagaacccaggggcaaatgttgcagccagccgagatcacgccattgcactccagcctgggcaacaagagcaagactccctctcaaaaaaaccaaaccaaaccatagcaaatcaaaacaaaacaaaaatcagaatactgtgattggaaaaatggggtacatgtgcaggatgtgcagccatcagatggctagattttactgtttcacactgtattagttagggatctgtaaaggacagaactgatggatagatgtgtatgtgcagcagggtttgttaaggagtattaacttacacaatcacaaggcgaagtcccaaaataggctgtctgcaagctgaggagcaaaaaaggcagtctgagttccaaaacctcaaacgtattgaagccagcattgcagcctttagtctgtggctgaaggcccgagatcccctagcagatcactggtgtaaattcaagagtccaaaagcagaagaacctggagtctgatgttcgaagacaggaagcatgcagcacgggagaagttggaggctggaagactcagcaagtctagttttccatgttcttctgcttagtttattctagtgctgctggcaactgattagatggtgcccacccagattgagggtgggtctacctctcccagtccactgactcaaatgttaatctcctttggcaacaacctctcagacacacccagaaacaatactttgcaccctttgatccaatcaagttgacacttaatattaaacatcacctgcagacctggactttaatgattcctgagtggcctcactccagcttcaaagggcaggcttgaatttcttgccaaatttgaacttcccactgccattcctgtgggccataactccggacctgctggatgacttcaaaggatcataattgcgttggtattgggaaagttgtgaaggagcccttgtgacaaacaggaagcagcagacagtatgaaagacactgcagagacaagaagcgttgcctgatacatgaccctagcaactctctagctgctaagggaggaaacagagctgggaccaacacagccagtctacctgtgagagggctcaatttcccacatgaccagagcttcccatcctccatgcatgggaatctatgaccaaacatagatttccacaggatggtgggtgggtgggacaaagtctacagattctgagcagctggcaagtttcagggtaccagagtaaacactgtcacgtgacctcagattgcttggtggttgaggccaaattatttactacctaccattttcagtgtagctctcccacttgcctcataaaatggagcaccataagggaatggaggtcacacagggacctccctgtgaatgcatgcaatgcatgacattcagctatgctgcagcccaagcaaagcctccacatgatatcaagaggacaagaggtcacatgtattttctgttccttttgcctgtgagttcccatctgtccaagtaagacttcacctgtgcaaaacagacgctgatatctgcagatgaagcacatatttcatcagtaattgtatattttgtagtagcctttgtggcccataacaaagatgatatttttgtctaaaaacactgaattgcaaaggaggtggacaaaattgggttctcatgcatatttgcatatattctatagcaacatttatcaaccatgggggatgttctctgaaaagctgtaatcatttctaaactggtttttaatccatagtgggttgtaagattaatgttgtcagccacaaacagcattttaaagaatggagataaaatatattactaaatagcgttcactgcatatagaatatacaaatacactacacatccccatgtacaaacgtatatttatttgcctagttgactatatataaactgtgtatttctcacacattgtcataaaagagtttgaacgtcactactttagtggttattagaaaaaatgtttacaggccatttctttagccatctgtgaagatgatggattaagatttgctaagaataagttcactgttgtctgtggctttctacataatgcttgaaatggcactcagtgatgcttaaactggtcagttttactgtgggcatttgaccctcagcaaactcatttgtgaactcatgagctggtgagaaggaaggctgatgagttgtggggctttacttcctaccatgtctttctgcagctgcaggtgtgaccatgtgtgtgcttctgcactcgtctgacagtgctttgatatgttcccttttatttgcccctttattattgactgtgtcttatagttcctattatgtacttcattagcatccagtgacagcgacatctgtggtattcagtgttgatccaatttacacaaattttaaaaatattttcaagcatgaatattttttcttaccaactttccttaagtacttccaggagtcaaatgcaattcaatattagtagttgatgttagaccatactggggtataatcctggaaaattactgataatactaattgttgttacgcctcagcttttatgtcaccataatgcttagataaatggcacaatgaccaacacatggaaagaaggattctgaaatattgacattttttatttccaaaatttactttaagctcaggggtacatgtgcaggatgtgcaggtttcttacataggtaaatatgtgccactgtgatttactgcacacatcatcacatcaccctggcattaagcccagcatccacgagctactctacctgaccctctccctcctcccacccccgcagtccagtaggctcagtgtgtgatgcttctcccatgtgtccatgtgttttcatcatttacctcccacttataagtgagaacatccggtatttggttttctgttcctgcattagtttgctaaggataatggctgccaccaccatccatgtccctgccaaggacatgatctcatttttttatggctgcatggtattccatggtgtatatgtaccacattttcttgattcagtttatcattgatgggaaggacatctcaaataccacaaagacacttggtccttgttgtgggaaatatcggactgtggtggggcagacagacaaacagaacagcagtagaagagcaaaggagaaacacagggaagggaaccagaggaataaaaaacaatatattggccatgagacaggggaaaacaacacaatattttaaaaaggtaatctttctcctttgcctttgccacttttctgaaaatcaacttattaggttttgtgagtctattgctggctctattttgatttgttgacttttctccaataccacactgtcttgaatactggagaagtaacacaattgccatatggggctggatgattaagaatcataatcaacaacttcatgcaatgcttcctaactcaaggcagcaccctcacctcagctgaggatcccatgcctcccaccttctcaggggctccgctcctgcactgatctctcttctctcctgaaccatcaacggctccttctatactggatcaatccccaagccaagggggaagtcaccttcttccaatgcactgataacataatcaatcaataaatataatagaattaatgtgaatcttgacctcctgtagggtgaattccccaaagttaaacttcagaattgttttggatattctgattcattttcctttgtagataattttgaaaatggactccagtgaagtgtgttgcataagttcatgcagttttcctttgcagggcaggaattaaatgtgttcgtagctagagaaggacatgggggaagagggtgagttttcccttagcttggggaatgatccaatgtagagggagcagttgatggttctggagagaggagtgatcactgtaggagcaaagcccatgacaaggtgggaggcatggtatactgacctgaggtgagggggctggcttcagttaggagtattgtatgcagaagggcagcagagaatgtccatgaatcactgaaggtgagggtggccttgggggtccctgacacagtgtcagcaaccgtgtgattcaccagcaggaccctgactcactacaacatggtgaaactttctttgagtaagggaagagcgaaggggtagagatgaggaagctgtcactcctgggagactatggatttccccatagtatgaagcagcagctgagctgttgtctattatgaaaaatacttgtactcacaacattcacaataatccctccaactgcaagggaactggctcactggatccctcaactgctgttctgtgcatgataatatatggggggaaagcgcagtctttaatttttgttttctcctgcaggcaggtagagactggatacaattgttgccaatgaactttcagtaggccaaaaatcctgaaggtttgaattgttctttcctctaagtgggagggaaaaaatcagtttcctgggctaaagcaaagccttagataaaacttaagtcttagataaaggaaaaaaagtgagaaaaaaagaccactggcagtggctcacacctgtaatcccagtattttgagaagctgagggaggagaatcacttgaagccaggagttcaagaccagcctgggcaacatagtgagacccctgctctacacaatttttaaaattagctgggtatcatggcacatgtctgtagtcccatctactcaggaaggtaacacaggaggattgcttgagcctaggactcctaggttgtggtgagctctaagtcctccagtgtattccagcctggatgacagagagaaaccctgtctcaaaaagggagtggggtgtgtgaagacacatttcagccttgtcttcagctggactgccactgctgcagcctcctcccaacatttgaggcaggatttctcttggccatggaatcataactctgtgaatgctgagttcagtgctagggttttgatggaaattacaatgagataaaaaaaaaggtacagttgtaaaatgtctttgtgttttgtggctattacatctggatgtgtgatactgacggagagggtccagcagtttgactacttaatgcagttgccacaagtgaggaattcatcttttctacacttctcactggataagggatagagacaaaagggatggatgttatgtaaactgatttttaaaatttttatgaattcaggatttcatcctgtccatttcttaaatatgatgaatcttttcactaagtttatatcataatgtgtttttctgaagatgtttcgtcccttctgcttacaacccttccagaaaaaaaaaggtctggaggacgaaatgggatgattaaagagataaaaacttttcatcacaggatacaacatggtgattctgtaatagtggagaaaacagaaaacctggcacatgaggagaggcaagggagggaaggaggacatcggttgtctctgtttttcaaaactattcctgcacactctccacttttcctcagaaatacttcccatgagggctttccaagccactgtgagccattgttaaaaccacattcattggtgagccggtgattaccttacaggtattcaaggaaatcagctaccagtcaagaggtataaaagtgcaataacacaaccttaaaaaaaagtacaggtgtgaattgattgtctacagcatgtataaaaattggcaggcatgggaggatcacttgaggccatgtgtttgaaagcagcctgagcaactcagtgacaccccgcatctaaaatataataattattaaatacgttaggagggcgtggtggcggccaactgcagtcccagctacaggggaggttgctgtgtgaggaggattgcttgagcccaagagatggaggctgcagtgagccatggtcatgccactgccctccaccctggacaacagaaaaacaccctgagaaaacagtatgtgtaaatatagacataaaattctttatttctgtcacaaaaggtctttctgagacacaccctccactaagggtgacatgggactctctgttctcaatgtttctggatgcctgagaatggctgggcaagagacaaaaaaaatttaaaaaatctctcatgtccctttcttcctactacaaactacctgggataagggtgtggggatagcaggaaaaccctggccggccctgcatgtgcctgactcagtgtgcatgccccttgctgcacaaggcgtagtggctcacatctgtaatcccagcactttgggaggccaaggtgggtggatcacctgagttcaggagttcgagacgagcctgggcaacatggcgaaaccccgtctctactaaaaatacaaaaattagccgggcgtggtggcacatgcctgcaatcccagctactcgggaggctgaggcagagaaactgcttgaatccaggaggtggaggttgcggtgagccgggactgcaccattgcactccagcctgggcaaaaagaatgaaactctgtgtcaataaataaataaataaataaataaataaataaataacagaaaaatgaggctcagagattgagacttaccaagaacacttgactcatggaggaggaattcatattttgttccaaggtttgcattcttcccaccatccatgtcagaaaatgtgaatgattttgcttaaaaatgcttaatactcaaatatgtctgcactgtaaggtactcagcattgactcaggacaaaacgcagttcagtgaagtaggatagcgtctccagaaaagaggccaataaatgacagccactgtttcctctgatgcctatttttgacagtatgtttggtaaaaggtggataattcaggacactggaatacagataactatatcagtaggactttgaaggggcttttaaaagttgtttcaatatttttataattagaaaactccaagtacaataagattatcgtgaaacagaaattgtttcctcaacgaatagatagcactttcgaactaaagatagacagaatttgggccatggattattttagcaattcactgttaaggggtttccagaatatgactgtcaacaatgcccattaatttctctgcacttcagttcccgtactctcattggaagacagtggttttgctgttgtatcaggtactttttcttaatgacatatagggcctttggacctaaacattaattaagtttaaccccaacactttcagggtacctgaacagggaattagtgtcaggactataagatttgtcataagcagaccagtacattgatctaatcattcagaacattatatttaaggtatgattaaaatgctatccacggggcagtcttcagatttcctaggtagctgagatacttcagatttcctaggtagctgagtgtttataacacacaatgttaaaaagtatgggaaatgtaggtgtggtgtgatttatcctcagattgttagttaagatatcataatacaggaaaacaaacggggacatctttgcatcacatttattaccacagtagcctacaggcttttattgcatcacactgaggaaaagaataggatcatttccttatttatcattctggtttggctgctccagtcgatatccttggtattttttagtacctgacctggaagctgatctccagaagctgtctcagtcaaagactggggatgaatgtggagttggccctggtgtccagggggaagattctgacaaaatgagagcaatttaaaatgccagaaggaggtatgttatccattaagattcaaaattacgtgctttctgtattccataatattacacttttgataatgaaaagagagaacattactgcccctttaaaaacagagtccaaatgcagactttctcgggaaggtagtcgagaccccagaagcctgactgcaaaactgaaagactatcagatacagacacaaactgggtcaaagccatattgaatcatcaaatagaagcgggggctcacgcctgtcatcctagcactttgggaggccgaggcgggtggataatttgaggtcaggagttcgagaccagccagggcaaatggtgaaacccagtctctactaaaaatacaaaaaattagccgggcttcatggcaggcacctgtaatcccatctactcgggatggtgaggcagaggaactgcttgaacccaggaggtggaggttgcagtgagccgagatcatgccactgtactccagcctgggcaacagagtgaaactccgatctcggggggaaaaaaaagaaaggaaaagaaaaaagaaaagaaaagaaaagaaaagaaaagcattttcttacttctgagtataaccaacagctaaaaatttgtagattattttctactttctgcttttcacaaatacataatacatttgtaataccacttcgtatgaaatatgctgaccctgaagaagattctaataccagctctaagataatttgtgagattctggacaaaacacataaatcctgcaccggtttttgcttttattgaaagtagtgaatgcacatcagatagattaaaatcatttcattgctgatttctgcatgtttcggttctgttggagaaaatacaaagataatttcattttcgtgatttgtttatcataaccatcagcttcagtccaattataatatccgagttgagatttcattgctcctaagtaaatgagctggcactctacttgatgtttgttttcctgtatggagaccttcatgagtgttcttggattttgtcaaatcctgaattctctcaggctcttaaacaatgattgctttttttttttcagtaggggtctcactctgtcgcccaggctggagtgcagtggtctgatctcggttcactgtgatctccacctcccggtttcaagggattctcatgcctcagactcctgtgtagctgggaatacaggtgtgtgccaccacgccggactaatttttgtatttctagtagagacagagtttcaccatgttggccaggctgggctcgaactcctgatctcaagtgatccacctgcctcagcctcccaaagtgctgggattataggcatgagccacctcccttgctggacccagtgattgcattttaaagtcttcccgcagtgagaccttgaatgactgaataataaaatggaaagagacagtcaagtttttgtgacccaagaagtagggagcatgcatgtaggtcagtgatgctcaaggtgtttgtaagatgcctgggctaagcatgctccctgccctcctgtcagtcttcatgagctactgtgtataattagattgaagacacatatggtaacctctaaccatatcagaggttatatattacaggtttctgccttgagtcatcagaagatacgatttaaagttcaaagactataacatactaagtcctgagtagtccacgtaagtatcttttacacatgttttccaaattgctgacttaattagaagaacttctgaatttaaaggaagcactgcatgtttaggggagaaattacctaaatgtttttactccacacttctgaaccactccattaggctattaacattaaaagattgttttcagatgatttccaggaggctactgaacaagcctcagttgtattcttaggacagtcatagcattaaatgtatatcttattaaaatagatagcaaattccatgatacaagaaaataatattaagaaagagcaaaataataagagtcacagaataaacttaagggaaaaaggcagtaaatgaaaggtatgcatcattaacaaaaggaaaactaatttgatattaataaatttaatagaatgttcttttgagaaatagctaggaagagcatccagtagattaaacaatcttgaagaaaatggaaaaggcacaacacagaatatgaacaagacacagatattgaatgtagggcataattgaaagggaatacattcttgaacactaatgttttcagagtgtggatgatatggttgatatgctcagaatgcctacactatttaatatatccctgaaatacctgaatatctgaacatcacaaagactgtggaaggacgtgaaatttgccagttgtacctcaaaacacagtcaccttttttttttttttttgagatggagtctctctctgttgcccaggctgcagtgcagtggcacaatcttggctcactgcaagccccgcctcccgggttcatgccattctcctgcctcagcctcccgagcaactgggactacaggcaccagccaccacgcctggctaattttttgtatttttagtagagacggggtttcaccgtgttagccaggatggtcttgatctcttgacctggtgatctgcctgcctcggcctcccaaagtgctgggattacaggcgtgagccactgcgcccagccaaaaacagtcacttttagaagcaaatatttagctttccagatgtgttactctccgattttgtttccctctccatttctttttctttgccacattgcttatgatgtataactgtttcacgttttaatgtcaataatgacagtgatatcttaaaacttatattaccatttaattaattatacaaatgggaatactttccggtgaaaaatgtatcattattcatattgacataatgactataggtgaaaactggatgcaaatggttagtgtatgtcaaaaaaggactaagaagggtaaactagcccaaagcaatattattgcacttctgcacaatagacaaaaaacaaatgcaatactggaccttctattcacttcacttacgtatttcctaatgtatcataactgttttcagttacattatggcaaaacatacttctcagactatttgcaggagcctattggacatccaggtgatagtttcaagccaaaacattaaattatatatttttcacaaattccttcggttgcttaggttttttgtgttttagttgcattttgagtaaaactctacacaatgtttgctatctactttaagccccttttaataggttcacttgatttaatgtgttctggtctcagactgtcttttggtttccttctagcaccaaaagcggggtgtgtttaaaaaatgttgtttaatgtgtatgcttggaggtgttatgttcaaagtctctacagaggtctagtggaatgttagccatagggtgactcttacttaggcttctggtttttgtccaatgtataaaactaaaattttggtgtcctttgtatacctttaatttcatctgaatacagttctgctagtaatgttccttcctgttgtgtttctattgcaggggaagggcaaccacagctttaaacaaaggcaagctgaaagaatgcaaactggatttatccgagatatttgacttttaaaaatctcaataaagatttccagttttctccaaataagtatcacacatcttttgttcatttattctcgcatattagaccctattgtaaattttggccgggtggagtggctcatgcctgtaatccaagcacattgggatgctgaggcaaggggattgcttgagcttgggagagtgagacatgcctgggcaacatggcaaaaccccctctctacaaaaataaatgaatgaatgcatgaatgtatgcatgtatgtttgtaggtgtagttccagctactctggaggctgagatgggaggatcccttgagtctaggaggtcgaggatgcaggtagtcatgttcacaccactgcaactccagcctgggcgaatgcgactctgtctgaataaaatatagtatcatttttgcaactttgcattctgattgagctggtatacacatgtgtgatattgtgaaatatatatatttggtcctggaccctgcttactgtcatacagctcctacaggttttagaatcgcctcatagcgacgtctttttgtatgctagtgagttgactgatggctggcagctcctaggtagctctaggatgggagcttagagggttcgcactttcagctgcatccccaaccttcaggacagggagaggggctgaaggttaagttgattgccaatggcgggccaacagtttaatcaatcatgcctttataatgaaaacctccatcaaaacccaaaaggacagggttcatagagcttctgcctagcggaacacatggagggtagcatgcccgtagagggcatggaagccccctgcctcttccttcattccttcccctgtgtatctctgtatctgcatccttcgttaggatatcccatttgccacaagatatgtgagaattccctagactatagagctggatgaaagaactagcgcctaggcagaagaaaaaggaaagcgactaggtcaatttgctgaagcaaaattacttggatcctacctacactgtctccttacaggcaatggcatggcatagccttgggtgtccatcctgcctctcaaacactggccttgtgatgttgggcaagatacttacatcctgtgggactgtttccccatttccaaagtagaaattagaatatttagactaaatacttgctttgaagaataaatgaaataacataagatgcaggcattacattgcagataaatttactagttatctttccttaatccctttaaaatttcacattttttttacaactacatctctagtatgtgataagtgctttggaatttcaagtaggaatattagtctaccttttaaaatgcatttgacttcagaaactgatttgatgtaaatatgtaaattaaatagcagttgtagctggtatcagacatggcattgcttttgaagttgatttgtaaataaccgaggtgtgacaaggccaacactaagtcagtagtacgtgctgaaaacttgtttggtgtgtgtgaagccatgaagaataagtctactccagtcagtcaacaccacacaactcaatatcatcgtgtgtcaagagctcaggcagtccctaagcagccctgtggtggctaacagggacacaaggatcgccagtgcggttgttattttgtcttgtcatatattcatagatttggtgggtaagaagacaatgaggccaaatggatcgaaatggttgattacttgcagacggaacaaaagcaagatcggcattgtgtcaacactgtgtcgctactcccacagtactacactgaattggagatactcagtaacagcacagatggtgggtctctctgcctgtgaggagcccacagtcaaaacctaaggccaattttgaaaccacactgaatcctgaacccaaacttacatctgaccgagctgtgaccattgggcagcaggggtgacccagctgctgaacatcccacatagaacacctagggatgtcattcacacttgtgaataggaagaactagtgtcaatgactactctgaactgactgcctgctgatagttccactaaatgaaagatgcaaatcaattgtttggactggacaaagaaccctagagggaaaggtccctcagtgggaggccacattgggggccttggccagctcctgcctgatgactgtatgtcctgctgggggtgccttaacaagggtaaactcttggtgtccaggggtatcacctgtgccctctgggattgttcttacctgtatgccctgactatcccaccactgcctcatccctggaaggcattcacatcagcttcggcttcctggccagagttgttatgaccctgaaatgctggcttgggttggacaaaaatggataatacagaatcttagttaggaagtcacctgcctttgtcagataggccttcatcattattaggatttgtataagatggctatgatgggaaagctgatgtgtcaactttgctacgccacaatgcatgagaaatgttcactttgaccagggtagatgctctgtgaagggttttctttaggagaactaacatttaaatgagcagactttcagtaaacccaattgccctctccagtgtgggtgggcctcatccagttccttgaaggccttcagagaagaagactgcggttctccacaagatgaagaaattctgcctccacactgcccctggatttgagctctcatatcatctcttccccgggtctccagcctgacatcctgctctgcgagatttggacttcccggtcacaacagctgcatgagctaggtcttcaaactcaatctttctctctctctctctactcactcacataaatacttgggtgcacagcccaccccacgacacacacacacacacacacacacacacacacacacacagaagaaccctaaccaataggctgcttatatttggggcccttaaagtgcataactgagatcgatactgcaggttgatctcactctgctgcatggctccaaacgcagaggcctgtggtgttcccctcccatgcactgacatccatgctgctcgtcactgcgactcagggtttggtcatctaaccatgtagaggtcactacaattctacaagtgttctctgccctccttctgcatgtgaggtcctctgttccatcctgagggcacagagatctactgggtatgtttccatccttccaagaaggactttggagcctggtgagggagatacacctgcaacagcggtaacagcaacgggcatagccagtgtgttcaccaactcatgagagatcacactaccaacatctcccacataaatttccccatcaacaaagagcttatcatggaaatgatcgtgttcgtaggtatgttggattccccttattctattttccccaggaatgcacagatacaaagaaaactgatgctggaatgttgtgttggagtgcaatctaagaatggaatgccctgcagtgatgtgatttctgaagcagtcaataagtctttataagttcttagatgaagcaacatacaagtctccctcagtttacagggaagtgacatgtatggaaaatccagtttatggaagactttggaaaaagatgtttgcctccctgtaacactcattccccaaatgccagcagcccctaccaatcattccaacaaccacagctgcactcagaaaagtccaaaatggcccagtaggtaacgatattctggctataagccacaagtttatgattgaaaagaagtatcctcaaacttcttgtttacataaaaagagtagggatattgtggtcggtacaaaggaaataacagggcaccaaggaggaggacacaatgtccctgggaggggttacaggcaccttcctcctctgtcttgctttgctttctgtgataagaaagtggttcagggataggcgtggtggctcccgccagcttgggggacatagggagaccccttttctactaaaaattttgaaaaacagccaggcatggtggagcatgcctgtagtctcagctacttgggaggctgagatggaagcatcgcttgagcgtgggagtgagccatgatttctccactgtaatccaggctgagcaacagagtgggaccccatctcaaataaaacagaaataaaagaaagtgtctcagggccagctgcgatgggtggtgaagcttcatttcaaaggtcaatcactgccatgaacattaatactcagatggttctgtggtagtcatagctctgagatcctgggactgatgtccttcttgatgaggatagccctctccaggctgggacacaagagcaaggtgccaggctaggtcatcaggctaccagggacagctgtctgctgtgggatcacagatgagatcaggagaaggacagctgaagggaggagaagggagacaacctcctcagaggaggtgcaggtgtctgttactgaagggaaggcatttgccctaagtcctgacattgctctaggctcccatggatggacacgatggtaccagaaagatccaaggctggtgggaggagcacgatagcttccatcacctcccatcttatgtgttcactggtcccttagggaagtccatgcaattttggaatctaaagggttattttctggcattccctccattcaccacccacaaagagaagggatttgagataaactgaggtcttcagggagaaaggccagatggagttgtgaggccttctcaaaagtccctctgccctacccttatggtgagtctcacactgcattcatcatgtcttgtgttcctgtgtgctctgaggtctctcttctcaacctcatgtctgtcttgggaagagtgggtatattgcagacagttttgcaacctaagggatttaatcagttttctgaaacttccctagcctgggcagtaaattcccagatcctagggcaccattccgaccacactacatgagactcactgggtgtgaatcatggaatcttcacttttaaaggatcctggattccaactttcatggaaacttgtctgagaactagtagagcaggggagtagtctcctttcccagctgcacagcttctttctcctttgtgaaggtatagaagggacaggtttttttgtgttctctgatgtacaaacccaagatcttcaggtgaagacatgctgccgttatggtaatgacacactcagggcactgtctccaaatcatacccaggccaatcctttcaagtctccatctcttaactatttctgaagaaatcaaatgtctcttgcctgtgcagtcccatgctataaaattctaaatattttgctatagcctttggctcttacccttcagatcttacccttgcacaaatatgcagcacaatagagttttccatgatgcctctgacctgtgcctccaccactcagtgctggtgacactgagaaagttacttaacatctctgtgactcctttctccaatagtaccatagaaatactactagtaaatttatgtagttcttggggcagtttagagcactgagtgtgtgaagaaaacatgtacggttgtcaggaaagtccctggcatatggtcaatttccaatcaattctagctgttactgttttgctgtttatattgttgctgttcccacatttccctgggagcatgttccagagatacaatgtcacaactacctttgaccccttccatgatcttttgattatcacttcatttcttcagggactcaaggactgagtctgtgggggcagggtgaggccatatttttatgagcataataaatattcagctctccttacagggtattgtggagcctaaatgtaatgctgggatttcatcatcatgagcttgtatgaaaaatttaaatggaaatttctctaggaaatcagaagtctaatgacctcttcatgtgatttgtataatgcttggaaaagtaattagtgactggataaggatagcatgtaaatatataaatattaaaaattttatgaattttctatttcatagtttgtgtgttttgtatcccatctatcgttgttttacatgttgccacagattctcctacattttcttctagaagtgtgataagttctatgatgcattttgaattaacttttgtatatggtgtgagacaaaggttcaggttcacttgtttgcatgtcaatgtccaattgttccaccatcattctctgaatacagcatcctttcccactaaattatcttgggaccttatggaaaaaaattaacgagaatatataggtctagctttggcccttatttctttccttatgccaatatcacagtgtcctgattaccacagttatgaaatacatcttgaaaacaggtaacgattcctccaatattctttgttctttataaaattgttagactattccagtccctttgcttttccatataaactttgaattcagcttatcaatttgtagaaacaaaaagttgcatggattttgattgtggttacattgaatgtgtagttcatttgggagaaactgacatgttcacaatcttgagtattgcaatccattaacgtggtatacctctccactgatttcagcctgctttaatatttcacagcaatgttttttaggcttctgagtacaggttttgcacatattttgttaaatgttaccactaaacatttcatgagattttgccgctatattaagtggcattgattttaaattttcaatagtttgttgctgcgaaagtcaaacttctcttgtacatattaccatgctaaactcacatatacatgtataaatatattcaagtcatggggtgaatctcatttggctatgatgttgtaaatttttaatatattcctagttttgacctgctattattatagcataaacataaatctatgcttttatagacatgagttatattagtctgtcatgttgttttttcatgatgtttgtctggttttgataccaggttgatgtggactctgtaaaatgttttgaaaagtgtgatctcttttcaattataaagagtttgtgtagaaacaacattatttctttcacaaatgttttgcaggattatccagtgaagtcaccagaaacgtgaaatttatttgagaaaaaatctttatttcatttctttgtttctgatgtatttcttcctttttgatgtataatgtaaaatgtataatcttttgcaaacactctttttaatgttctggcttgaatctatggtctgtatgccaaatgggctcctggaaatagtctctcttggaagaaaatggttaatgtcaccttaggaactgcatcagggaagtgaatagaaaggccagcattgcatttatttttactctattgtgcagaagggcaaaaatatttatttgggctcgtttaccctactgtggtttttaaggtacagtaaccgtttgtacccagttttcttctaccgtgatgtcaacatgaatgatgcctctttttacacttgaaagtattcccatttgtataattaaatataaggtcacattactcttaagctatcactatcagttttgtcatcaatgtgtgacagcattatgaactgtgccacacacgaaaaaatggagggatatggaaatggaaaacaatagtaagacatctgaaaaagtcaaaatcagtttctgaaagtaaatgggatgccttccgagcttatcaaccatttcattcatgctctgaaaatattagagttcaagattttattcactttcaataatgccctatattaaatcaccctgtcttgttcatattccatgtcgtgctttttccattttctgcaagatggtgtaaactactgaatactctattcatacctatttttcaaaagaccattcttttaaatgcattacatttgaattattttttcttttactgatgatttgtaactgtcttttattcattacctctttctttttcctttaagtttattctgtggctcttttattattatttcatagtattattttcttttatcatgtaatcagctatttattttaagaagatttgcatttaaagctatgatctcccaaaaaataaaacagagtcttgttcaataggctgctggaaatcgtccgagaactatcttttaacgtaaacagtctaatggaatggttcagcagaggagagtaaaaacatttaggtaatttctcccttaaacatggagtgtttcttttaacttcaagaggtattctaattaacagtcaccaatttggaaaatatgtgtaaaatatatttatgtcaaccactcaggaattagcacattactgttattgtactttaaaccctgtcatctaatgtctcaaggcagaaacctgtaatgtgtaatgtatggtatggttagaggtgactctactatatgagtctttaatctaattacacgaagtagctcatgaagactgactgacaagagggcagggagcatgcttagcagaagcatcttacacccaccttaagcatcactgacctacatgcattctccctgctatactggccacagaaatctgatgatctcttgccattttatcattcagtcattcaaggcttcactgcgggaaggctttaaaatgcagttattctttaagagccagagaattcctttggcaacaacctctcagacacacccaggaacaatactttgcaccctttgatccaatcaagttgacacttaatattaaacatcacctgcagacctggactttaatgattcctgagtggcctcactccagcttcaaagggcaggcttgaatttcttgccaaatttgaacttcctgctgccattcctgtggactgtaactccggacctgctgaatgagttcaaaggatcattatagtattgggattgggaaagttgtgaaggagcccttgtgacaaacaggaagcagcagaaagtatgaaagacactgtagagacaagaggagttgcttgatacatgaccctagcaactctctagctgctaagggaggaaacagagctgggaccaacacagccagtctacctgtgagagggctcaatttcccacatgaccagagcttcccatcctccatgcatgggaatctacgaccaaacttagatttccacaggatggtgggggggtgggacaaagtctacagattctgagcagctggcaagtttcagggtaccagagtaaacactgtcacgtgacctcagattgcttggtggttgaggccaaattatttactacctaacattttcagtgtagctctcccacttgcctcataaaatggagcaccataagggaatggaggtccctgtgcattcacagggaggtctccgtgaatgcatgcaatgcatgacattcagctatgctgcagcccaagcaaagcctcctcatgataccaacagaagaggtcacatgtactttctgtcccctttgcctgtgagttcccatctgtccaactaagacttcacctgtgcaaaacagacactgatatctgcagatgaaacacatatttcatcagtaattgtatattttgtagtggcttttgtggcccatatcaaagatgacatttttgtctaaaagcactgaattgctaaggagggcgacaaaattgggttctaatgtgtttttgcatttattctatagcaacatttaccaaccatccaagatgttctctgaaaaggctttaattatttcttttttttattattatactttaagttctggggtacatgtgcacattgtgcaggttagttacatatgtatacatgtgccatctaaactagtttttagtccatgttcgatcataagattaatgttgtcagccaaaaacagcattttaaagaacagcattttaaaaaatggaggtaaaataaattactaaatagcgttcactgcatagagaatatacaaatacactgcacattcctatacacatacatatatttatttgcctagtcaactatatataaactgtgtatttatcacacattgtcataaaagagtttgaacgtcactacttcaggggttatcagacaaaacgtttacaggccacttccatagccatctgtgaagatgatggattaagacatgctcagaataagttcactgttgtctgtagctttctacataatgcttgaaatagcactcagtgatgtttaaattgtcagtttgactgcagggtgtgttcatgtgtgtgttcctgcactcatctgatgatgctttgatatgtctccttttatttactcctttattatttactgggtcttatggttactattgagagaagagagagatcctctcatattgttttatattgttttatattcagtatcttttttaagaaaaaacaacaaggaagtaaaaccaaagacaggcagccccgcgccaggcccaaaacctgacccgggcctgcctggcctaaacctagtagttaaaaatcaactcatgacttagaaaccgatgttattcatagattccagacattgtatagaagaacattgtgaaactccctgccctgttctgtttctctctgaccaccggtgcaggcagcccctgtcacatacccattgcttgctcaaatcaatcacgaccctttcatgtgaaatctttagtgttgtgagcccttaaaagggacagaaattgtgcattcggagagctcggattttaagacagtagcttgccgatgctcccagctgaataaagcccttccttctacaactcggtgtctgagaggttttgtctgcggctcgtctggctacactattatgtaattcattagcatagtgccagtgacatctgtggtactcagtgtcaatccaatttacatgaattttaaaaatgttttcaagtgtgaatactttttcttaccaactttccttaagcacttcaaggagttgaatgcaattcaatactagtagttgatgttatatcatactgagctataatcctgctaaattgctaatctactaactgttgttatgcctcagctttcatgtcaccataatgcttagataaatgacacaaagaccaaaacatagaaataaggattctgagatattgacttttttttaatttccaaattttactttaagttcaggggtacatgtgaaggatgtgcaggtttcttacacaagtaaatgtgtgccacggtgatttaccgcacacatcatcacatcacccagatattaagcccagtatccgtgagctgttcttcctgatcctctccctcctcccacccccgcactccagtacgccccagtgagtgatggttctcccatgtgtccatgtgttttcatcatttacctcccacttataagtgagaacatccggtatttggttttctgttcctgcattagtttgctaaggataatggccgccaccaccatccacctccctgccaaggacatgagctcattcatttcatggctgcatagtatttcatggctgcatagtattccatggtgcatgtgtaccacattttcttgattcggtttatcattgatgagatggacatagcaaatatcacaaagacacttggtccttgctgtgggaaatatcgcactgtggtggggcagacagacaaacagaacagcagttgaagtgcaaaggagaaacacaggaaaggaaaccagaggaataaaaaacaattaatgtagtggccacgaggcaggagaaaataacacaatttttaaaagataatctttgtccattgcctttgcctcttttctgaaagtcaacttattaggtttgtgagtctattgctagactctattttgatctgtagattttcccccaatatcacactgtcctgaatactggagaagtaacataattgccatatggggctggatgattaaaaatcataatcaatagcttcattcaatgctcctaactcaaggcagcaccctcacctcagctgaggatcccatgcctcccaccttttcaggagttctgctcctgcactgatcattcctctcccctgaaccatcaacggctccctctatattggatcaacccccaagccaagggggatgtcaacttcttccaactcactgataacataatcaatcaataaataaaatagaattaatgtgaatcttgacattgtgtggggtgaattcccccaagttacacttcagaattgttctagatattctggttcattttcctttgtagaaaattttgaaaatggactccaatgaagtgtgttgcataagttcatgcagttttcctttgcagggcagcagacacatgtgttcgtagctacagaaggacatgggggaagaaggtgagttttcccgtagctggagaatgatccaatgtagagggagcagtcgatggttcaggagagaggagtgatcactacaggagcaaagcccatgacaaggtgggacgcatggtatactgacctgaggtgagggggctggcttcaattaggagtattgtatgcagaagggcagcagagaatgtccatgaatcactgaaggtgagggtggccttgggggtccctgacacagtgtcaacaaccgtgtgattcaccagcaggaccctgactcactacaatatggtgaaagctttctttgagtaaaggaagagtgaaggggtagagatgatgaagctgtcactcctgggagactatgcatttccccatagtatgaagcaacagccgagctgttgtctgttatgaaaaatacatgtactcccagcatttaacaataatccctccaactgcaagagaactggctcactggatccctcaaacgctgttctgcacaggataatgtatggaggaaaagtgcagcctggtgctgactttaatttttgttttctcctgcaggcaggtagagacaggacacaattgttgccaatgaactttcagtaggtcaaaaatcctgaacgtttgaattgctgtttcctccaagtgggagggaaaaaattcagtttcctgggctggagcaaagccttacataaaccttaaaacttagataaaggaaaaataagtgagaaaaaggccacgggcagtggctcacgcctgtaatcccagtattttgagaggctgagggaggagaatcacttgaagccaggagttcaagaccagcttgggcaacatagtgagacccctgctctacacaatttttaaaattacctgggcattgtggcacatgtctgtagtcccatctactcagaaacgtaaggcaggaggatcgcttgagcacagaagtcctacgctgtggtgcactataagtcgtccagtgtactccagcctgggcaaaagagagaaaccctgcctcaaaaaaggggttgcaggtttgtgaagacacattccagcctcgtcttcagccgggttgccactgctgcagccccctctcaacatttcaggcaggatctctcttggccatggtacttgcaagtgtgtgaatattgaatttagtgctaggggtttaatggaaattacaatgatataaagaaaaccgccacagttgtaaaatgcctttgcattttgtggctattaaatctggatgtgtgatatcgatggacagggtgcagcagtttgactaactaatgccactgtcacaagcaaggaactcatcttttctacacttctcaccggataagtgatagagacaaaaggattggaggttatgcaaactgagttttacaattattacaaattcaggatttcatcctgaccatttcttaaatatgatgaattttttcacgaaatttatattacaatgtgtttttctgaatatgtttagtcccttctgcctaccacccttccagaaaaaaaaaaaaaaagttttgaggaagaaacgggatgatgaaagagataaaagcgtttcatcacataatactccatgctgatttgttaacaattggagaaagcagaaaacctggcacatgaggagaagcaagggagggaaggaagacataagtagtctctgtttttcaaaactgttcctggaaactctccagttttcctcaagacatacttcccatgcaggctttcctagctgctgtgagtcaacgctgaaatcacactgactgatgagccatgatcaccttacaggttttcatggaaatcagttaccagttgacaggttcaaaggtggagtaacacaatattaaaaaagcacacaagtgtgaactgattgagtctacagcatgtataaaaagcctttataaaaattggccaagatgggaggatcacttgaggctgtgtgtttgaaggcagcctgagcaacacactgacacacctcatctaaaaaaaaaattaaatacattaggtgggcatggtggcggccatctgcactcccagctacttgggaggtttcagtgtgaggaggcttgcttgagcccagaagatggatgctgcagtgaggcgtgatcatgccactgccctccacccttcacaacagaaaaacaccctgagaaaaaggcatgtgtaaatatagacataaaattctttatttctgtcacaaaaagtctttctgagacacactccgcactaagggtgacgtgggactctctgttcccaacgtttccggatgcaggagaatggttggacaagacacacacacagacagacacacacacacaaacacagacacacacagacacacatacacacacacacacacaagcacacacacaaaagctctcgcgtccctttgtttccactacaaacaccctggaattcgggtgtggggataccaggaaaaccctggtcggccctgcctgtgcctgactcagtgtgtctgctataaagacacatgcacacgtatgtttattgcagcactattcacaatagcaaagacttggaaccaacccaaatgcccatcaatgatagactggataaagaaaatgtggctcatatacaccatggaatactatgcagccatgaaaaaggatgagttcatgtcctttgcagggacatggatgaaattggaaaccatcattctcagcaaactgacacaggaacagaaaaccaaacactccatgttctcactcataagtggtagttgaacaatgagaacacgtggacacagggaggggaacatcacacactggggcctgttgggcgatgggggtctatgggagggatagcattaggagaaatacctaatgtagatgacggcttgatgggtgcagcaaaccatcatggcacgtgtatacctgtgtaacaaacctacacgttcagcacacatatcccagaacttaaagtataatagtaattttaaaagaaagaaaatggttcacggcaaggtaaggtggctcagacgtcaaatctcagcatgttgagtcatcgaggcatgaggattccttcagccccagagttcacgaccatcctgggcaacatagggagaccccgttttacaaaaaattttaaaagcatatacccaggcatggtggagcatgcatgtaattccagctacttgtgaggctgagatggaaggattgcttgagtctgggaggtcaaggctactgtgagccatgatttctccacggcactacaggctgagcaacgcagtgagggcctgtctcaaatgagacaaaaagaaaagaaagtgtttcagggccagctgcgatgggtggtgaagcttcatttcaaaggtcagccactgccatgggacactgatgctaaggatggttctgtagtagtcatggctctgggaccctgggactgatgtccttccactcggggagggcagccctctccaggctgggacataggaggaaggggccaggctagatcatcaggctacgagggacagctgtctgctgtggaatggcagatgagatcaggagaaggacagctgaaaggaggagaggggagacgcactgctcaggcgaggggccggtctcctaaaaagggaagacattggccctaagtcgtgtcattgctctaggctcccgtggaagcacatgatggtgcaagaaggaaaccaaggctggtgggaggggaacaatagcttgcatcatgccccatcctatgtgttcagtggcccctgaaaggagcccatgccttttggggatcgaaaaggtcatttcctgacacaactccattcaccacccatgaggagcagggatttgagataaactgaggcctctggggagaaaggccagtaagagttgtgaggtcttctcataagacgcactgccttacccttatggtgattttcacactgtgttcatcatgtcctgtgtttctgtgtgctctgaggtcgctcttctcaacttcatgtctgtcctgggaagagtggatatatttcagacagtcttgctacctaagggatttaataaagtttctggaagttccctaggctgggcagtgaattcccagatcctaggacaccattgtggccacactacataagcttcactgggtgtgattcctggaatctgcacttttaacagatcttgggctctaactttcacagaagcttgtctgagaactactagagcaggggaatagtctgctttcccagctccaaagcttctttctcctttgtgaaggtatagaagggacaggtttgtagtatataaaattttaaaaatgtatgtttgttctatttcatagtttgtgctttttgcatcctgtctatctttatcttacacgatgctgcagattcccttacattttcttctacaagtgttgtaacattagctttcacatttagttctatgaagcattttgagttaacttttgtgtatggtgtgaggcaaagtttgaggttcatttgtttgcatgtcaatgtccgactgttccagcaccactcctggaataaaacatccttccccactgaattctcttggcactttatggaaaaatccatttaacttgaatatatagatctagcttcggactcttatgccttttcttctgccaatatcacagtgtcctgattagcatagttgtcaaatgcatctcgatatcaggtaatgtgagtcctccaatattcttggtcctttataaaattgttaggctattctagtccctttgctttcccatataaattttgaagtcagcttgtcattttatagcaacaagaggctgcagggatttttattggtttacactagacatatagattatttgggagtaactgacatattgacaatcttgagtcttgcaatccattaatgtggtatgtctctctatttatttcaacgtggtttcatatttttctgaaatgttttttaggcttctgagcacaggtcttgcacatattttgttaaattttaccactacagatttcacgggggggtttgctgctatattaagggatatcgactttcaattttcaattgtttgttgctggcatataaaaatagcattgacttttccatgttcatcttgtaccatgttactttgctaaactcacatggaggaaattccatttggctaggatgtaaattttttatgttgctagtttctaactccggttaattgttttttacagagtttgtgtctatgttcatgagttacattggtctgtcatgttattttctcataatgttgtctggttttgatatcaggcttgtgcttgctctgtaaaatgctttggaaagtgtggcctctcctcaattatcttgagtggagaactggtgttatttctcccagaaacgtttggcagaattatccagtgaagtcaccagaaacatgaggtttaattgagaaatatctttgttgagtttctttgttgcttttactgaatccaattcctttaattgatatacggctatatatgtcgtttatttgttttttaacgtttcatttatgtccatttttatgggtatttagtaggcacacatacttgacatgttttgatgcagcttgcaatttgaaatgaggacatgatggagattgaggtattcctcctctcaagcatttatccactgagttgcaaataatccaattatactgttcatgttattttaaaatgcacagttacactctttttttgtttgtcttttttagcacttgtccactgtttattcattggaaggaaggcccggtcctaggtagactcgacctcccccgaggaaccttggagccaaaggcaggaggcttccagaatgcttagactctgatcctccttactatcaccctgagacctgtctcaccaaagccttcttctgtccatggttttctcactggatctacaagggaatccccccacaagtctggggtccagtgtggtcactcctgatggttttcaagaaggggaaggccaggaacctagggaaatacctcatttggcccgaccacaactggccagagcaggacaaacatgccatgccatgtcaggcgcccagttacccagctggagggaaagtcagtcctgagagggtggaaggggccagtcacaaatcccggatagatagtgacctgggctccacaggtgagctgggctctgatggctttccctgcctttggaaacaaggaggagaagttttttgcagaaaaagcctcttttccttccagaactgctgttttatgacagctgtttcggcagtgagtcttgtgtctgttatgagggtgggtccccctcttggccctgctctacagaaaatgatggagcagggcaagctgtcctcagtgaatgtacaccagaatggcctggacgtgagccacgccttcagaaaccatgcgtgctccaagagcgctacagcatcaaataaggcctatggagggtccccatctgaagggcatcggggaggtctctgagtcgaggtaggtgtctcagagaagagggtgacagcccagcctactgcctggagttctggcattgggtagggactgcagagggcccgggaacggggaggctttcagggaagtcctaggggctctgaacacctctgctccttccatgaggacaaggaaatgttgtgcacccagactgccaccttaatgtgcttcccacagcactcaattgatggggcaaggatgcacaggagaccgccccccctccccagtccagtgaccctgctgcccacagtgcctggcttccccgctgtagggttctgacccctccagaatgatcctgctcgtctcctctgcacaggaggcagaggcacgtccctgcagggcacagaaaccatgccgacatcccacagcaggggctggggctcagagccggcatcgtgtgcagactgggctaggactcaccttgggagagaacttggggagccccttcttccaggggccacatcccactgagatgagtcgacccccatgaggatctgcaggatcttgtctgacatagcctcattgggaaggggggtctgatactgtgcagagtgggtccccggcactacagactgggatcccaataggctctgctcactccaccagccatcagccttgacaggccaggtcctcccaggcctgctgtccccacagaccccttttgggctcatcctgaggctctgggaggtctgccttctgcagggcgagcacaagctcacagccaggacataagcggcattcaaagttcatagaaacttgtccccatgtgcctgaaggtagcaggaggaccacacaagacagacctcaactgtcctgagggcagcacttgcactgtccacacgaccctctgctctggcctagagggaaggccaagccaagccaggcctggtcagctgtgcagggcaccgtgagtccttctggaaactgagcccacccctgacacgacacagatgaaaggcaggagcgtggtgagcattcccctgcctgggccttccctgcatccatggcctcctgtgcacagctggaccccagggttgtccaaaaggggcccagcactgcccactgggaagtgcccagagcagaaacgaggtgaaggcacagacctctcccaggagaccccacctggcctgatgtgcagccccattcctagaacatctcctgaagctgtctctctttggcccatgggagctccttcaggacatgctgtctcaggcctggactcttgaggaccacgtggtgctcaggcctccatggtcgagttgagaaggacacactgcgacctgcatcccacgtgggctccagcctcccgagtcaccctctgaggcattaaatcatggggagtgcccagaaccctccatccctactccctgggccttcctccttttcctcttccttctcaaagaagtttctgaaaacaggccagctgggccccagggcaggtgctagactcgcctcagtgacagggcatgggatgagggcaagacccctccaagcccctcccccacacccttcccctcctggcctagaagaaccctagggggcactggaggggttggtcccatctgtgcgagccaacacccacagctgccagcaccaacgccagagaacagcaggggcgcctcactcacaagcacccctccaagtgtgtcacgacggcaagccttgagccagggaatggagagaatcagtgtctcagacccagagagaggattcagggaaacggtgcagtaggccccttggtgtgggaagtcatggcatggcgtggattgtccgggatggcagaggggcccagtgcccaggagcgtctcacgcgctatggagacagatcctcatcttaggtggcaagggggccaggtgacaggtaaggcctctcccagctgggttctgcaccagggctgaagcccagaccgagccgccctggggtgagggtatgaggcctggagccccgagccagcctgaaccctggggtccgtctcaggagcagcctgagatgctctgacagcaaccatgccccaagctgcacgcacccctcactctgggttcagcagcctgtgggtgtttcctcagtgtcacaccaggtgggccactagagacccccaaaactccaggggcccaggttcatgaggcccagccctgcaaggaacaaatgggcttggtggagaagtggaccaaatctgcttttctttcagccaaacccgcaaagatccctaggaaggtcctgggcctggagcgagtgtccctggcacccaggcctctgtgggcatccctcagcatgcagaccctccccaagggggatgggctggccctccgtggcccaccagcccagctccagaagtccagaagctgaccctgaggccaaggcccagcagcatgaggggacttctgcagagccccgggcagcaggacactctctgggggctcagccgcccagagtgcagcaagtctgttcctatctcaggacagaccccaggattttgggcgatttctgtgtgggtgtcctctcccaaaactccccatgtacctggacatccagggctcatggtttctacagtgcagctttgagcaggcatgctgaactcctattccttccacatctgctctggacatcgccaggaccaatggacaggcccatccctgcaaccccagcagggctccaacaaccagacccggcccaccccactgaaaacccagaggtaggaccacagaaactccccttgcatggtggcatctggatctgacgtttctctgaggatagtgacctgcacagccccaaagcagtcagtactactgctaggccatatgggatcaatatcaatggggaagctgggccctcagaggctgctggaggggagagtgactgtggcatctgcacagccccagccagccagcagcatatcacatgtcctcatgtctgcccattcgtgtgacagagcctctctcacatggcaagcgtcctagagccatggggctgcgatccagcccaagccctccccaaccaaagccctaagagaaaaaggacccaggggagccatgggtgccccagaaacagctaagatggatacacaggggactgagttcctgggacactggccagaactagactgtggcccaaggcagggcaagccccttaaagcagtgtgtgggtacgcagggcctgtgcatgcctggcagagccaagccagtgacgttaccaggctcaaagagcaaccatccacgacggccatggtggggcaggagcaggtgggccagccccctgcctcatcaactcaaggaatcagggatggctgggttcccaggccctgagtgcccaccacctgaccattagtgaggcagagacatgaggccaatcacatgatcctggggccctgcttccatcttacaagaactccttcagctcacagcaccaagaaaaatcctgggcaagtgagggtccaggaggccaggttcctacgtctattctccttgtcaggtgcattttgccactgggaaaagtcagaaaaggtggcctcagtccatgtaagcaggctccaaagtaggcaccatagctgcagggggagaaggagctcctggcggcactggaataggctctggcaggatcccagattctgtgattctgtcccccgcaacctgttttttgttttgtttttttttttgttttttttttttttttttccccttgagtgcttggaatcgtccccattttacacggagtctgcagccattgacaatcagtttattagaggacttgtcggcacccacttctgtagccaccctgtggaaagctggatgaaaggcacactgctatctctgcacaacggtgaccatccggatctcaccaacaggcagagacaatttcttaaatctgtctgagtaatggtatccgccagatcaccaacatacactctggtggaatccttctctgctggtgattcaagatgaagcgtggttgaagcctgctttagaagcttatctgctacagggtcattgtttccacaatatcgatctttaatattttgaccagcaagagggggtcatcgggatctgcaggcttctcatgtctttacggacagtcctctcctttcacctggacagaacaaatgtaaggcttattcctcagccagtacagtgtggtccgggccagtttgagcagcatctcactactggacgtggctttccccagcagagcaactggccatgttctatcagggttagaaattcctctgtccatatctgcagtcacctttaaaggcaagtctgtgtcatgaacctgtatgggcagtcatactctaggtctaagaggcaagtctgacagacatttcctgcaggcttggcccccttcagtcttcttgggatgcatgtgctcccccgggcaccagccaaacactgaatggcctgacagagtttgcattttttctcatagttctccttggtcatgtttctctgagacatatctggcacagaatggagaaatcgacgtcctcccagttttgcctgttttaggcgctggaacccagagaggtcgccatcttgagagggtcggcaggcagcagtagatttccaggtgggagagaggacccccagaatcccaccagacccagctctccttcctggtgctgttcttgaggccctggataattgcctttcaccatacgtgagtcatctttcttgagtcaaggtgaacctcacttccaaggaatccccattcttgtaggacactctgtgcttcctggtctctccaggagctggctaaaattctatgctttttcattggaatactgagatagacagaagtgcagtttttttacaagtgtctttatccagccatggcattaatttcccgtttggtaggaggacaatagtcttattttcatcagtatgtgtagtgcatgttagtgcacagcatgaaccttagaggaagacttctaccttgagatgtgaaatgcatcaatacttgtgtggagttaataaacctgctctacctccacaagtgtcagcttcctcacccatacaatggggatcacacaacgacttcttcaagttgttgccagagttacattcaccaagatatttaaaagtacctaactacaagggtccacagcattaataaaactgcatcagacttcaatgcacacaaaaggaataaagtacatgcgtccaaagacgagatgagcagctttctaagcagcctgatgagcatcagaatgagatctacatttaagtagaattcttcacagctccactgaagaggacacacatgggggctccaagaagataagcacatggccattgcacagtaactggtgtagtgtggatggaatccctgaagaccctctgaaatatcattacacaactggctctcagggaacactggaacaaatcaggaaactcagcagatgctaccaggaactgggtgagcagaggggggtcacatccacaaatttaagcagaagacaccaaaccgcaaggagctcctggctctgcaacagcagctgtggtggcatcggggccaatcttctgagacagctgctgtgggattgctgagaccatgtgtttttgcagccacacacccaaaagcagtgcatttgaaaacggatcacaacactctcctctccattcatctttgttttaagatgactgatgatggataccctcacattgcaacatccccaccaacacttgtggacaatcgtatttagaaaatcccacctaaagagggaacagtcaggagtaggatgagaatattgagggatgggggagagatgcgggtacttcaccccagactctgtttgaaacaagagccattgtgctgtggtctccctatacttcctcattttgccgcattcgtagatgccacctggtttttgtccctttacttacaaaggtgctgatgagcccatgggtggttaatcctgaaggaggaaattcttcacaaaatacaataacagagtctaatttcaatgaccaggttttttagtttttttttttttttcatagtatcccacattaaaaatcacaaatgaaacctgttggaatgtgtgatatgaacaaagtcttattttcatgcagattaacaacttggcttttacggattacacataaaagcataaaagctggtaccatcccagaatcaaaggaacagtcccagaggacatacggaatttagtgacatcaattattaagaggctacacgaaactggaagtgctcccagaagttttcattgtctagacagaaaaattcaagacatcagccccatcgagtaaaggtacgtcccctggctgccgtgggtgatgagcttttcattcaaagcagagatatgaagcctgaggtgtctcaaagtcaccccaagtgctccacaccttgaaagtcactcccacaaagctggaacaccatctgttcctgaaggatcaggtcatgacctgtatctttgagacactgggcagtcaggcctcagttgagatgaagccaatgatttcaagtgtaaaatacctaaaaccaaatctttaggtatctattagcagccccgtccacttaaatgggttggtgaacatggcccatcagacagacacacacctgagcactggggttttctcctctgttcttagcatcccctgggtaaaccagtaattaccctccctcatgcctcaacgttcacatctgtgaaaaaggtgatggggagagtggcctttccaggaaagcggagcacatgtcaacacctgctaagctctgaatttgtgcgtgggcccaggcgacggatttctccagaaagcggctgaactgggactctggctgaagagagcggaggtcagcagcacaatgcacagcccctgggacctcaggccagttccatagcagcttaggaaagcagttgggtccctaggctggaggaggcccggtgctctggaaagatccagggtgcgggtggagaggaaacggagctgagcagtgagaggtggggtgagcaccacgtccatccggtttgggcaaaggcaaggtgtcctttgcagtgtcacaccctcctcactactgagcccagaactgcctctcatggccttctccagactcacttcccatggccaggaggtggcacatgatcagtagccggcacatgatcagtagccagcatcattcttctatacagttaacttcttattgactaccgtctctcggctgtgctatcaaataggacgtcttattcagtctttctaactatgtttttggtacccattaccatccccacatcccccaagctccccactacccttcccagcctctggtaaccatccttctactctctgtgtccatgagttgaattgtttggatttttagatcccacaaataagtgagaacaattgatgtttgtctttctgtgaatggattatttcacttaacatattgatctccagttccattcatagttttgcaaatgagtggctctcaattttttttatggctgaagagtactcccttgtgtgtatgtgccacattttcttcattcctctgttgctggacgcttaggttgcttccaaatcttagctattgtgaacagtgctgcaacacacatgggagtgcagatatctcttcgatatactgctttcatttctttggggcataaacccagcaataggattgcttgatcatatggaagctctatttttagtttgtagagaaacctccaaactgttctccgtagtggttgtatattacattcccactgacagtgtatgagggttcccttttctccacatcttcgccagcatttggtatttcgtgactgttggttaaaagccatttgaactggagtgagatgatatctcattgtagttttgattggcatttctccaaagatcagcgatgctgagcaccttctcacatgcctgttttccatttgtatgtcttcctttgagaaatgtccactcaaatcttttggtgatttcttgatcagatattagattttttccgatagaattgtttgagcttcccgtatactctggttattaatccctcgtgagacgggtagtttgcaaatattttgtcccattctgtgtgctgtctcttcaatgtgttgattgtatcctctgctgtgcagaagcttttgaacttgatgtgatctcatttgcccgtgtttgctttggatgcctgtgcttgtggggcattactcaagaaattttcgcccagggaaatctacaatctaaatgtcttgtagagtttcctcaatattttattgtagtagtttcatagtttgaaagcttagatttctttaacccattctgatttgatttttgtatatggtgagagataggggtctagattcattcttctgcatatggatatccaggtttcccagtaccatttattaatgagactgtctttccccagtgtatgttcttggcacctttgtggaaagtgagttcactgtaagtgtgtgggtttgtttctgctttctgtattctgttcaatgggtctatacgtctgttttaatgtcagtaccgtgctgtttgggttactatctctctgtagtatgatttgaagtcaggtaatgtgagtcctccagatttgttcttttttgtttagaatagcttggctattctgggtcacttgtggttccatatgaattttgtgattgctttatccatttctgtgagaaatgtcactgtctgttgttgtttgttttttttttttagggattgcactgaatctgcagattgcttgcttgtatatgttttagaatgagttttgctagctagtgtccttcaaataattttttctttcaatataaatataagtttttggataacatttcttgaaaggttccctgttgtacatttaatatctaaaggatctgtattgacgtaacgaccctctgggtttgctgatattaatatttgtagtctctgtgtctccctctctcatcagtctggataaaggtttattaattcgagttgtcttctcaaagaaacaatgtctgggtttcactgataatttctatagatttttatcaattctatttaattcatttttcctcatgtcttttaaattttttccttctttttttctccttttttttttttttttttttaacagaatctcgcactgtcacccaggctggagtgcagtggcatgatctcggctcactgcagcctgcacctcccaggttgaagagattctcctgccttagcctcccgagtagctgaaactataggcgtgcaccaccagcccagctaacttttgtatttttagtagagaccgggtttcaccatgttggccaggctggtctcgaactccagacctcaggggatcggccacctcagcctccaagagtgctgggattacaggcatgagccactgtgcacggtctaacagttttccttctgactttgggtataatttgatttcatttttctagtttcttaatgtggaaacctagataattgatttgagacttttcttcctttctggcataagtattgaagggtataaatttccctctatgctttagtttcatcttgcaaagtttgataagttgagttttcattttaaaattttttcctgcaatttcttctttgatctctgagttacttaaatgtgacatttaatttccaagatttcatgagttgcagacatctttctacaactaatttccatttcaattctttttttggtcatagaacatgttttataacatttcattccttttgaatttgttgagatttgttttttggcccacaatatggtctatcttggtgaacattctatgagcacttgagaagaatgtgcattctgctgttgatctatgaatatcaattaggccatgctgtctgatagtgttgttcaagccttctgcatttatatatcctgattttttgtacactttttctaccaaatgctgggagtaatggggaagtcttctactaaaggcacatgtgtttatttcttctttgtgatgatgtatcagttgtccctcaagtattttgaagttgcctacatatccgtggtgtttctgtcttctgaatcaatgcacctctctatgattattatgtaatgtcccactttgtcccttgtagtaatctccactataaagtgtgctttgtgagatactaatttcacactttgagtttatgtgattcatatttgcaggaaatatctttttccatcttttacttgtatcttatttatttgtagagtggggctctttttttcaagatacagattactgataaatatactgtgaaaatcaagatcctcttgcaactgtgcaacaacaataaaagtaccgaaaaattagatgcagaagttaatatacaactaaaatgttacgcagaaatccacagaataatctgctcggctcttcaaaagaacctcaatcaaactctttgacagccttcatagaaagatatcttcacattaaagtggtatatttatatgaaaaatataattttatccccctattttctacagtagggttttgggtaaaatttcatttcacgaaggtgttcttttgctaaaaatcctttgagaaacaactatataaaatgatctctcagagctctcttagctttgaaatgtggagattcaaatatccctctgtagattgaggaggagatgtaaaaaaaaaaaacaaaacaaaacaaaaaaaaaaacaaaaaaaaccacgggggaggaaatgttggtctcctgcacttttcttttctttttcttcctagactaaccagtttgtgttggtcctccgctgagctgttaatccagggaagagttgcccttctgaagaatatgtggatttaatggagaccaaggcaggtttgaatcgctcagaaacaacagccagaataacttttgaagggctgtaaatgaagatgattcaaatcctctgatttatgttacttttcactcaagtttctaaaagtgccttcccatcaagagctgtttggctagggacagaaacgtttgttcagccctatttttctcttccttccttccttccttccttccttcctgcctcccttcctgcctccctccctccctcctttacttctttccaccctccctccctcgctccatttgtccttattttctcccttcctccctggctcccttcatgcctcactcccttccttctttcctaccttttataaaaagaagtgaactgatatttgtaaagtagaaagatcagaagagttcacaattattttcgagttttcttttaacttttattttgggttcagggtgcatgtgcaggtttgtaatataggtaaactcatgtcatggggtttgttgtacagattatttcatcacccaggtagtaaggccagtgcccattagttattttgttgatcctctccctcctcccagcctctaccctctgataagccccagcgtgttggccctctctgggtgtccatgtgttctcagcaattagctcccatttataagtgacttcatgtggtattgggttttctgctcctgcattagtttgctaaggataatggcctccagctccatccgtgttcctggaaaggacatgatctcactgttttttatggctgcatagtactccatggtgtatatgtaccacattttaaaaagtgcagtctgttattgatgggcatttaggttgatcccatgtctttgctattgtgagtagtgctacaatgatcatacatgtgcatgcgtctttataatagaaaggtttatgtacctttgggtatagtcccagcaatgggattgcagggccaaatggtatttctgttcttaagtccgtgaggaattgccacactcctttccacaatggttgaactaatttatactccaaccaacagggtataagcgttgccttttctgcacaaactcaccagcgtctgttatttttgttcttgctttttatccagccttatagactctgactctgttttttgagacaggatgtctttctgtctgtgaacgtgaattccgctggtgtctgagacttgccaggattccagctctctcaaatgcctgtgttcgaactttatgaatttgctacattttcactggttttcttcttaccccctgttatggctgtcacttcttccacacatgctctgccacaggtgatgcagtttgtttgtctcatccctcctcagagggactaagtcaccattttggatcagttcccatggctgccttgttacctcaggtctctcatgatctaaaaacaaagcaaaacaaaagataacgttatagattattaggctgtttttcattttcaaggctaaagtgactttctcttgaggctttctaaatcttacctggtggtagaactctcctttgttaatcttttgactactggtacaaaaatacagcattcaaatatgtgaagtaaaagataatccaggggctagctgactatggcttgagatctaaatacagcccatggcttgttttgcatagccattgagataaggatttttttccatttaaaagtattattgctaaaaaacacaacactacgccacagaaactacatgacccacaaagactgaaataattacgatcagatctgttaaagcaaaatttggtgatgccgtattaatcaaatacctgttattctgctttgcattattgcatacatcttttcatccattaattaatttatttacacacggattgaaaatatggatgttactctatcccctcaagaaagcgtccagctttatgataccatgatttcagtctgggaaacttgtcccagggatcaggtcaatacacaaacatacatttgaggtaggagactggcaggacttgttttctggtcataactgagcctagagcctacagtcagaatctatggctatttctgaaacatatactgtctgaatgacctacaggtatattcagggaaatcagttaccagtccagagatttaaatgtgaagtaacacaacctaaaaagaaaagagtaaacaggtgtgaatgtatttattctacagaagaatttattcaattacgtttattggaagcatggcagaaaacccagaaccagagaacaaagtgattaataaaagcatttataaaactggccaaggtgggaggatcacttgagcccaggaaattgagaccagcatgggcaacacagtgagaccactatctaaaaaataaataaataataaataaaccaattacccaggtgtggtgtctgcacctgtagtagcagggactggggaggctacatcgggaggattgtttgagcccaggagatggaggcttcagtgaggtatggtcatgccactgccctccagcctgagcaacagagtgacactctgtctggaaaaaaaaataaataaaaacggctttataaataaagatatgaaaataatttatttcttccacaaaaggtcttcctgagacacatcctccagtaagggactgtctgttcccaacgtttctgaatgcatgagattggacaaagagagacgaaagctctcaagtccctttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagtgtgagtgagtgtgagggggagcgtggggggcttcctgtgggttgtgccacttggtccatggcctctgaggtcgtcatctttctactaaaactcagcgatactgccatggccttgctgttgtggggtcccgggcatgggacgaaggagggccatagcggggaggagggtcaggtgagcatggagtgagtttttttttttttttcacggagtcttgctctgtcaccaggctggagtgcagtggcgcaatctcggctcactgtaacctccgcctcccgggttcaagtgattctcctgcctcagcctcccgagtagctgggagtacaggcgcgcacaaccacacccagctaatttttgtatttttcagtagagacgggttttaaccatgttggcgaggatggtctcgatctcttggccacatgatccacccgcctccgccccccaaagtgctgggattacaggcgtgagccaccgcgcccggtcatggagtgagttttgaaggctgactttatttgaggtatttgagtcctggtgggggggaacccacacacagagaggagggattccaaagtcgttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaagaagtcttgctcatctttggttcacttccttcccaggtatttgataatattggaaattgtttctggctgcggttgtccacgcctgtaatcccagcactttgggatgctgaggcaggaggattgcttgagctcagtagtttgagaccagatggggcaacaaagcaagactctctctctacaaaaataaaagagtgaatgcatgaatgtatgcaagtttgtatgtagctatagccccagctactctagagccgaagggtggaggatgcctccagcccaggaggtccaggatgaggttaatttttttttgagatagagactctatttttttttttttttttaaaattcagtatcatttttgaaattttgtgttctgattgagctggtatgcacaggtgtgatattgtgtaatacatatttggtcctagaccctgcttcctggcatacaactactacaatttttaaaatctccacaaagtggtgtctttttatatgctagtgagttgactcatggctggcagcacctaggtagctctagtttggggaataggagggttggggctttcagctgcccctcccccccccccagcattcgggaagaggcagaaggttaatttgatccccagtggcaggacaacagtttaatcagtcacgcctacagaatgaaaacctccatcaaaaccaaaaggacaggattcagacggcttctggctagctgaacatatggagggcagcatgcccctagtgggcacagaagctccctacccctttccccataccttgcgctatgtctctcctcatctgcttcctttcttagggtatcccatttgccacaaaacatgtgagaagtccctaggctatagagctggatgaaagaattagggcctaggtaggagtaagcggcaaggaaccagggcaacttgctgaagcaagatgacgggtcctacctacaccgtctctttagaggctatgtcatgaagtagccatgggtttccatcttgcctctcacacagtgctcttgatatggtggtcaagatacttacaccctttgggactgtttttccatttctaaagttgaatttacaatatgtacactaaaaatacttagtatgaaaaataaaggaaataacatcaaggaggctttacattgcagataaatttggcctgctacttagatttccttttttcctttagatttcaaactttttcatttcatttttccttacaactacatttctggtgtgtgataacctgcttttgaatttcaagtaggaatgtcaagttcacttttaaaatacatttgaattcagaaaattatttgatttaaatatgttaatttaatagcagtgtagccggtgtcacccacggcatagattctgaagttgatttgtaaataaccgaggtgttataaagccaactgaatgtcagcaatgtgtgctgaaaacttgtttgctatgtgttatgcgggtggatcacctgaggtcaggagtatgagagcagcctggccaacatggtgaaaccccatctctactaaaaatacaaaaattagccagatatggtggtatatgcatgtaatctcagctactggggagtccgaggcaggagaatcgcttgaacccaggaggcggggcttgcagtgatcggagatcgtgccattgcactccagtctggaaaataaagagtgaaactctgtcaaaaaaaaaaaggaaggaagaaaggaaggaaggcagacaggaaaagagaaaaagagaaagagaagggaagaaaatgaagaaagaaaaaggggagagagagagagaaggatggagagggggaggaaggaaggaaggaaggaaggaaggaagggaagtccctctgtccgtatttgcagtcactttaaaggcacgtctgtgccatgaacccggatcggcagtcatactctaggtctaagaggcaagtctgaaagacattgcctgcaggcttgacatccttcattattcttgggatgcacgttctccccagggcaccagccaaacaccgaatggcctgacacagagtttgcattttttctcatagttctccttggtcattcagataatatgggttctctctaagacatatctggtgcagaatagagaaggttgcatcctcccagttttgcctgttttaggtgctggaacccagacaggtcgcaatcttgagagggtcggcaggcagcagtagattttcaggtgggaaggaggacccccgcaatcccaccagacacagctcttctttctcatgctgttcttgaggccctgggcaattgcctttgaccgtatatgattcatctttcttgtgtcaaggtgaacctcacttccaaggaatccccattcttgtaggacactctggacttcctggtctctccaagaactggctaaattccatgtttttccatcggaatactgagatagacaaccttgaagtgcagtttctttacaagtgtctttatctggccatgacattaatttcgcatttggtaggagggtaacagtcttattttcatcagtatgttcagtgcatgttagtgtacagcatgaaccttagaggaagacttctacgttgagatgtgaaatgcatcaaaagcttgtgtggagttaataaagctactctacctctacgagtgccagtttcctcacccataaaatgaggatcacaagatgacttcttcaagttgttgccagagttaaattcagaaagatatttaaaagtacctaactgcaagggtccacatcatgaatgaaatagcatcagatttcaaagtacacaaaaggaataaagtacacatgacctaagatgagatgatcagctttctaagcagactgacgagcatcagaatgagatctatatttaagcgatttcttcgcagccccactgaagaggacacacatgggggctccaagaaggtacgtacacggccattgtagaggaactgatgttgtgagggcggaatttgaaatgtcattacacaactggttctcagggagcactggaagaaaccgtgcaacccagcagatactaccaggaattgggtgagcagaggagggtcatggccacaaatctaagcagaagacaccaaaccacaaggagcttctggctctgaaacagcagctgtgatggcataaggagcaatcttctgagatagctgctgtgggattgctgagagcacatgattttgcatcaatacacccaaaagcagtgcatgtgaaaacagatcacaaaactctcccctccattcatctttgttttaccatgaccaatgatggataccctcacgttacaacatccccaccaacacttgtggacaagtatatttagaaactcccacctaaattgggaacgctcaggagtagggtgagaatattgatggatgggtgagggatgtgggttcttcacctcatagactctgtttgaaacaagagaagagctgctgtgctgtggtctccctatacttcctcatcttgccacattcatagatgccacatagtttttgtccctttatttacaaaggggctgatgaacccatgggtaattaatcctgaaggagaaaattcttcacaaagtacaataacagggtctaatttccatggccaagttttttaggtttttttttttttaatagtggctcacattcaggaatcacaaaagaaacctgttggaatgtgtgatatgaacaaggtcttattttgatgtagattagcaactaggcttttacagattagacataaaagcataaaagctggtaccatcccagaatcaaaggaatggtccctgaggacatacggaattagggacatcaattactaagaggctacaggaaactagaagtgctcccagaacttttcattgtccagatagaaaaattcaacaaatctgctctaataagtaaaggtacctccctgactgccatgggtgatgggctttccattccaagcagagaagtgaagcttgaggcccttcaaaagcaccccaagtgctccacaccttgaaagtcattcccacaaagctggaacaccatctgttcctgagggatcaggtcatgatctgtgtctttgagacactggccaaacagactctgagtcctgaatggatcttcactgggtaactgcatctctattcctgcattctgctgagatggttgatggagccatgagtcacatacctcacctcttaagcaatcaattgtccagctacatccttggccatgttttcatggcatgctatctgaataggctgagaatcttccaaatcatcacaggctgatttctttttcttagcagttctgttgttgatttatttctcctctcttggattttgctatcagcagcagggagaaacatggcaacatcttcaatacttggcttagaaatcttagctaaatacccacgttcatcacttgcaaattctactttgcatctaagagtatgcagtttagctaaattctctgcgattttctcataaggaatgtgaatccatgtttccaataacatgttccccattcctgtctgagacctcaccggaagcacctttaacattcatttttctagcaacattctgttcttgatgttggatgtattctctaagatgacagaaattttctgtatagctctcctgtttttttctgagcacttgccagaatttatcttaatgtccatatgtctaccaattgccccttcaaggaagtgtaggctttttctgtcacttactttgaaactcttccagcatctcttcacgacccaattccaaagctactttcatgctgttaggtatttgttagagccgcacttcatttcctggtaccacaatctttgagagttctctagggctgcagtaacaaatcaccacaaactcactggcttcaacaacagacatttattgtatcacagttccggaggctaagagtctgaaatcaaggtgtgggcagggttgactccttctgaggcctgaatggaagaatctgttccatgcctttctcatagtttctgttggcttgctggcaatccttgacattcattgaccagtagatgcatcacccctatctcttccttcatgctcacgtggttttttccctgtgtgcacgtcgtagtccattttgtgttgctataaaggaatacctagaaccaggtaattcataaggaaaagatatttatttagctcacagttctacaaactgagaaattcaagggaatgcatagccctctggctttcggtgagggatttcgatccacatcacaacatggtggagaaggccaaagtggaagtggacacttgtgaagaggggaaaacctgaggggtgtcgtggctttacaacaacccactttaaagggaatgaatccattccttcaagagctactccagcattctgaaactgagaactcacttaccatttcaccaagagatcagcaccaagttattcataagggatccacatccataacccaaactcatcctaacaggccccacctcccaacactgccacgggaagtggggggtcaaatttcttttttttcctttttctttttttgagacagagtcttgctctgttttccagtctacagtacagtggtgcgatctcagctcactgcaaactgtgcttcccaggttcaagtgattctcctgccgcagcctcctgagtagctgggacaacaggtgcatgccaccacttccggctaatttttgtatttttttttttattagatacagagtttcaccatgttggccaaactggttttgaactcctgacctcaggtgatctgcccacctgccttggcctcccaaagtgctgggattacaggcatgagccaccgcaccagggcaagggggtcaaatttcaacatgagttttcctggagacaaaccaaccatacccaagccataccaacgtctgtgtacaaatttccccctcttctaataacaacagtcatattagattaggggcccacccaacctcattatgacctcatctgaaattaattatattttcaataaccctatttccaaataaggtcacattctgcggtacctggggttaggacatcaacatatgaatttttcaggaaacccaaaataaactatgtgtattttgccacaataaaaaatgtttaacctcctcctgtgcagtaaactgcttcaagggcacctttggaaacatctccatgtgaacctcactgtccagaaagcttctttcacaataaacaccatagaaagctcttgacaggtatagtctccacaagaatttgaacaacagccactcccatctcctctgctctcccctgtattgctacttgttgctgctgctgctgctgctggaatgttgataactgctcctccctggatcccttgcagagggttgtgcgccacagtttaccaggtattgctaatgatatgccctattataaggtttgggaattagaagtaattttttagttctaccaaaaatggttgcagtgtgaatcatgaatgtggcaaagtttaggcaggtgggaatggcgaatgtgagaattttcagcaggtgcgcatggtgaatatggaatgtttaggcagatgtgcatggtgattgtggaatatttgggcaggtgtgaatcgtgaatgtgaaatgtttgggcaggtgtgaatagtgaatgtgggaatgtttggacaggtatgaatgatgaatgcagaatgttctggcaggtgtgaatggtgaatgtgcgagtgttcaggcaggtgtgaataatgagtgtgcgagtgtttgttatggccccgggattcccctactgatcacctgcctcaggattccaggaggcagagacatttggcagaggtttcctccagttgcctgaccatcaggtatatttcagtggactccaaatctagtatgatttccattatgtctgtaggttttatgagacttgaagattcttcattactattttctgtactgataatttaattaataattttctgtacatataatttaataacacatgaattcatgataagaaatgtaacaaatttgactttctcagttacattccactcaaaaacacatgagttttgtctgtttgactagtacttccattcctggtaaggttcagcaagagctgagatttctgagcttcagtgactacatcctaccttgcaggttacttgcaataatgaaataaatgatagtgataatagtagtaaaaatagtagtaaaagaaggctgggctcagtggctcatgcttataatcccagcactttgggaggctgaggcaggaggatcgcatgagcacaggagttccagaccagcctggagaacatggcgcaaccccccgcccctgtctacaaaaaggttaacaaaatttagtccagtgtggtgtcacacgcctgtactgccagctactaggaagatgacatggcaggatccctggagcaaggagttccagacagtagtgagccatggcaaagtcagtgcactccagtcagggtcacccagtgagacttggtgtcaaaaataatcagttttaatataaaaccaacagtcatactgttacggactgacttctgtctgcacgagattcatatggtgaagtcctaacccctagagcctcagactgtaactgtatgtgagatagatggggtctttaaaaaggtaattaagtgaaatggggtcattagagtagagtctaaggcaatgtgcctggtgcccttacaagaagaggaaatgaggacacagacttgtacagagggagggctaaggcagacacggagaaaacagctgcctgcaaggcaaggagggaggccttagaagaaaccaactctgctgacaccttgatctcagatgtgtagcctccagaattgtgagaaaatacatttttgttgtttaagtcacccagttcatggtagtttttgatggcagccctaacaaaccaatagaaacacttttagtgccgctcagaaggcaagcattatcatatctattttatgagctagaactcctgctcctccaactaatataatgagcatgtaatgatacctgtatctgagcaactgagcagtgatgagaaaacttcaaaactttggaattattttaccttaagtctatgaccacgagagaatcgcttctccctttcgcactcatcctacttccactactacaatactctcacaaattcctaggaaccctcctccatttgaatgacctaccctaatgattccttcagaagacagaagctatctgctgggaattctcagagcatcccaaacccaggctacccctgttgggcctggcattctctgccacccttgtgcatacaatgctcctaacggaagcaagcccctcacctcagctcaggatcccataactcccactttcccaggggctttcctgctgcaatgatcgttcttctctcctgaaccatcaatggctccccctatattggatcactccccaagctaagggggaaactcactttcttcccccatgtccttctatagctacgaatacatttagctgctgcccttcaaagcaaaactgcctcaacatatacaactcacttcactggagtcattttccaaaattacctggcaacaaaaatgaaccagaacagctgaaacaatgctgaactataactttggggaactcacactacctaatagtaagagtgatgttaattctatagtaatcaagagaacgtggtaatttggaaaaatcaacaaatcagaatggagtccagcaatagactcacagacatgatatattgattttcagaaaaggtgcaaaggcaatggagaaagattgtcttttcgtgaaagtgttattttcctcctgcctcttggccactacattgattggtttttattcccctgggtcccttccctgtgtttccccctttgcacttcagctgctcttctgtttagtggcctctctgccccaccacagtgtgacagcccccacagcaagtaccatgtgttgttggttgttcttccaatttccagcatcccaggtatttcttgtaacatggcaggccactcatgcatgtctactgaattgatgaattaaccttttgtaatgatcctaacagaaaagcatctcctgtgtttaggagacattattggagatgatatgtttctaggcaccttacatatggtctttggttttgtgccggacactctagggtaatggctctgtatgttgctctggagctcctgcaggtcaccactaataggggaagtaggcaaagctagactacaagctaacctgagtctgggcacaatatcttgactgcccttggaacaaggaaagataggcagggcggtgggagctgccacaggtatttttgcaccagctccctatctgcctggaggctgacacaaggccattcttcatccgtctccctagtttgaggtaagcacaggcctttcttcatcatagggtacagttgtggagtataaaattgctcactgcctttgggcacaggtgtgggctcctcaccagcagaaagacccactatctgtgctgtccatcactgagtacctccgattcactgtcacactatggaaatagggatacggtgcttacacaatgctgatcttgcttttgctttctctacaagcaatcaaccacttggatctgtttgggctcattgtctccgtattggccaaatttaagaatatgtgaaaaggcaaactaacgactttagtggtgatcctcatggcccttttaggacaacacagggctgcttacggaccgcttgagtaattgacacactactgtattgagttgcgtggtgtagcatagacagaatattgatttagtcttcatggcatcacacacagcaaataagttttcagcacatactattgacttatggttggccttgtaacacctcggttatttacaaatcaacttcagaatctatgccgtgggtgacaccggctacactgctattaaattaacatatttaaatcaaataattttctgaattcaaatgtattttaaaagtgaacttgacattcctacttgaaattcaaaagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaattttaaaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacaatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttatattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccataaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagatatcatctcactccagttcaaatggcttttaaccaacagtcacgaaataccaaatgctggcgaagatgtggagaaaagggaaccctcatacactgtcagtgggaatgtaatatacaaccactacggagaacagtttggaggtttctctacaaactaaaaatagagcttccatatgatcaagcaatcctattgctgggtttatgccccaaagaaatgaaagcagtatatcgaagagatatctgcactcccatgtgtgttgcagcactgttcacaatagctaagatttggaagcaacctaagcgtccagcaacagaggaatgaagaaaatgtggcacatacacacaagggagtactcttcagccataaaaaaaattgagagccactcatttgcaaaaccatgaatggaactggagatcaatatgttaagtgaaataatccattcacagaaagacaaacatcaattgttctcacttatttgtgggatctaaaaatccaaacaattcaactcatggacacagagagtagaaggatggttaccagaggctgggaagggtagtggggagcttgggggatgtggggatggtaatgggtaccaaaaacatagttagaaagactgaataagacgtcctatttgatagcacagccgagagacggtagtcaataagaagttaactgtatagaagaatgatgctggctactgatcatgtgccggctactgatcatgtgccacctcctggccatgggaagtgagtctggagaaggccatgagaggcagttctgggctcagtagtgaggagggtgtgacactgcaaaggacaccttgcctttgcccaaaccggatggacgtggtgctcaccccacctctcactgctcagctccgtttcctctccacccgcaccctggatctttccagagcaccgggcctcctccagcctagggacccaactgctttcctaagctgctatggaactggcctgaggtcccaggggctgtgcattgtgctgctgacctccgctctcttcagccagagtcccagttcagccgctttctggagaaatccgtcgcctgggcccacgcacaaattcagagcttagcaggtgttgacatgtgctccgctttcctggaaaggccactctccccatcacctttttcacagatgtgaacgttgaggcatgagggagggtaattactggtttacccaggggatgctaagaacagaggagaaaaccccagtgctcaggtgtgtgtctgtctgatgggccatgttcaccaacccatttaagtggacggggctgctaatagatacctaaagatttggttttaggtattttacacttgaaatcattggcttcatctcaactgaggcctgactgcccagtgtctcaaagatacaggtcatgacctgatccttcaggaacagatggtgttccagctttgtgggagtgactttcaaggtgtggagcacttggggtgactttgagacacctcaggcttcatatctctgctttgaatgaaaagctcatcacccacggcagccaggggacgtacctttactcgatggggctgatgtcttgaatttttctgtctagacaatgaaaacttctgggagcacttccagtttcgtgtagcctcttaataattgatgtcactaaattccgtatgtcctctgggactgttcctttgattctgggatggtaccagcttttatgcttttatgtgtaatccgtaaaagccaagttgttaatctgcatgaaaataagactttgttcatatcacacattccaacaggtttcatttgtgatttttaatgtgggatactatgaaaaaaaaaaaaaaactaaaaaacctggtcattgaaattagactctgttattgtattttgtgaagaatttcctccttcaggattaaccacccatgggctcatcagcacctttgtaagtaaagggacaaaaaccaggtggcatctacgaatgcggcaaaatgaggaagtatagggagaccacagcacaatggctcttgtttcaaacagagtctggggtgaagtacccgcatctctcccccatccctcaatattctcatcctactcctgactgttccctctttaggtgggattttctaaatacgattgtccacaagtgttggtggggatgttgcaatgtgagggtatccatcatcagtcatcttaaaacaaagatgaatggagaggagagtgttgtgatccgttttcaaatgcactgcttttgggtgtgtggctgcaaaaacacatggtctcagcaatcccacagcagctgtctcagaagattggccccgatgccaccacagctgctgttgcagagccaggagctccttgcggtttggtgtcttctgcttaaatttgtggatgtgacccccctctgctcacccagttcctggtagcatctgctgagtttcctgatttgttccagtgttccctgagagccagttgtgtaatgatatttcagagggtcttcagggattccatccacactacaccagttactgtgcaatggccatgtgcttatcttcttggagcccccatgtgtgtcctcttcagtggagctgtgaagaattctacttaaatgtagatctcattctgatgctcatcaggctgcttagaaagctgctcatctcgtctttggacgcatgtactttattccttttgtgtgcattgaagtctgatgcagttttattaatgctgtggacccttgtagttaggtacttttaaatatcttggtgaatgtaactctggcaacaacttgaagaagtcgttgtgtgatccccattgtatgggtgaggaagctgacacttgtggaggtagagcaggtttattaactccacacaagtattgatgcatttcacatctcaaggtagaagtcttcctctaaggttcatgctgtgcactaacatgcactacacatactgatgaaaataagactattgtcctcctaccaaacgggaaattaatgccatggctggataaagacacttgtaaaaaaactgcacttctgtctatctcagtattccaatgaaaaagcatagaattttagccagctcctggagagaccaggaagcacagagtgtcctacaagaatggggattccttggaagtgaggttcaccttgactcaagaaagatgactcacgtatggtgaaaggcaattatccagggcctcaagaacagcaccaggaaggagagctgggtctggtgggattctgggggtcctctctcccacctggaaatctactgctgcctgccgaccctctcaagatggcgacctctctgggttccagcgcctaaaacaggcaaaactgggaggacgtcgatttctccattctgtgccagatatgtctcagagaaacatgaccaaggagaactatgagaaaaaatgcaaactctgtcaggccattcagtgtttggctggtgcccgggggagcacatgcatcccaagaagactgaagggggccaagcctgcaggaaatgtctgtcagacttgcctcttagacctagagtatgactgcccatacaggttcatgacacagacttgcctttaaaggtgactgcagatatggacagaggaatttctaaccctgatagaacatggccagttgctctgctggggaaagccacgtccagtagtgagatgctgctcaaactggcccggaccacactgtactggctgaggaataagccttacatttgttctgtccaggtgaaaggagaggactgtccgtaaagacatgagaagcctgcagatcccgatgaccccctcttgctggtcaaaatattaaagatcgatattgtggaaacaatgaccctgtagcagataagcttctaaagcaggcttcaaccacgcttcatcttgaatcaccagcagagaaggattccaccagagtgtatgttggtgatctggcggataccattactcagacagatttaagaaattgtctctgcctgttggtgagatccggatggtcaccgttgtgcagagatagcagtgtgcctttcatccagctttccacagggtggctacagaagtgggtgccgacaagtcctctaataaactgattgtcaatggctgcagactccgtgtaaaatggggacgattccaagcactcaaggggaaaaaaaaaaaaaaaaaacaaaaaaaaaaacaaaacaaaaaacaggttgcgggggacagaatcacagaatctgggatcctgccagagcctattccagtgccgccaggagctccttctccccctgcagctatggtgcctactttggagcctgcttacatggactgaggccaccttttctgacttttcccagtggcaaaatgcacctgacaaggagaatagacgtaggaacctggcctcctggaccctcacttgcccaggatttttcttggtgctgtgagctgaaggagttcttgtaagatggaagcagggccccaggatcatgtgattggcctcatgtctctgcctcactaatggtcaggtggtgggcactcagggcctgggaacccagccatccctgattccttgagttgatgaggcagggggctggcccacctgctcctgccccaccatggccgtcgtggatggttgctctttgagcctggtaacgtcactggcttggctctgccaggcatgcacaggccctgcgtacccacacactgctttaaggggcttgccctgccttgggccacagtctagttctggccagtgtcccaggaactcagtcccctgtgtatccatcttagctgtttctggggcacccatggctcccctgggtcctttttctcttagggctttggttggggagggcttgggctggatcgcagccccatggctctaggacgcttgccatgtgagagaggctctgtcacacgaatgggcagacatgaggacatgtgatatgctgctggctggctggggctgtgcagatgccacagtcactctcccctccagcagcctctgagggcccagcttccccattgatattgatcccatatggcctagcagtagtactgactgctttggggctgtgcaggtcactatcctcagagaaacgtcagatccagatgccaccatgcaaggggagtttctgtggtcctacctctgggttttcagtggggtgggccgggtctggttgttggagccctgctggggttgcagggatgggcctgtccattggtcctggcgatgtccagagcagatgtggaaggaataggagttcagcatgcctgctcaaagctgcactgtagaaaccatgagccctggatgtccaggtacatggggagttttgggagaggacacccacacagaaatcgcccaaaatcctggggtctgtcctgagataggaacagacttgctgcactctgggcggctgagcccccagagagtgtcctgctgcccggggctctgcagaagtcccctcatgctgctgggccttggcctcagggtcagcttctggacttctggagctgggctggtgggccacggagggccagcccatcccccttggggagggtctgcatgctgagggatgcccacagaggcctgggtgccagggacactcgctccaggcccaggaccttcctagggatctttgcgggtttggctgaaagaaaagcagatttggtccacttctccaccaagcccatttgttccttgcagggctgggcctcatgaacctgggcccctggagttttgggggtctctagtggcccacctggtgtgacactgaggaaacacccacaggctgctgaacccagagtgaggggtgcgtgcagcttggggcatggttgctgtcagagcatctcaggctgctcctgagacggaccccagggttcaggctggctcggggctccaggcctcataccctcaccccagggcggctcggtctgggcttcagccctggtgcagaacccagctgggagaggccttacctgtcacctggcccccttgccacctaagatgaggatctgtctccatagcgcgtgagacgctcctgggcactgggcccctctgccatcccggacaatccacgccatgccatgacttcccacaccaaggggcctactgcaccgtttccctgaatcctctctctgggtctgagacactgattctctccattccctggctcaaggcttgccgtcgtgacacacttggaggggtgcttgtgagtgaggcgcccctgctgttctctggcgttggtgctggcagctgtgggtgttggctcgcacagatgggaccaacccctccagtgccccctagggttcttctaggccaggaggggaagggtgtgggggaggggcttggaggggtcttgccctcatcccatgccctgtcactgaggcgagtctagcacctgccctggggcccagctggcctgttttcagaaacttctttgagaaggaagaggaaaaggaggaaggcccagggagtagggatggagggttctgggcactccccatgatttaatgcctcagagggtgactcgggaggctggagcccacgtgggatgcaggtcgcagtgtgtccttctcaactcgaccatggaggcctgagcaccacgtggtcctcaagagtccaggcctgagacagcatgtcctgaaggagctcccatgggccaaagagagacagcttcaggagatgttctaggaatggggctgcacatcaggccaggtggggtctcctgggagaggtctgtgccttcacctcgtttctgctctgggcacttcccagtgggcagtgctgggccccttttggacaaccctggggtccagctgtgcacaggaggccatggatgcagggaaggcccaggcaggggaatgctcaccacgctcctgcctttcatctgtgtcgtgtcaggggtgggctcagtttccagaaggactcacggtgccctgcacagctgaccaggcctggcttggcttggccttccctctaggccagagcagagggtcgtgtggacagtgcaagtgctgccctcaggacagttgaggtctgtcttgtgtggtcctcctgctaccttcaggcacatggggacaagtttctatgaactttgaatgccgcttatgtcctggctgtgagcttgtgctcgccctgcagaaggcagacctcccagagcctcaggatgagcccaaaaggggtctgtggggacagcaggcctgggaggacctggcctgtcaaggctgatggctggtggagtgagcagagcctattgggatcccagtctgtagtgccggggacccactctgcacagtatcagaccccccttcccaatgaggctatgtcagacaagatcctgcagatcctcatgggggtcgactcatctcagtgggatgtggcccctggaagaaggggctccccaagttctctcccaaggtgagtcctagcccagtctgcacacgatgccggctctgagccccagcccctgctgtgggatgtcggcatggtttctgtgccctgcagggacgtgcctctgcctcctgtgcagaggagacgagcaggatcattctggaggggtcagaaccctacagcggggaagccaggcactgtgggcagcagggtcactggactggggagggggggcggtctcctgtgcatccttgccccatcaattgagtgctgtgggaagcacattaaggtggcagtctgggtgcacaacatttccttgtcctcatggaaggagcagaggtgttcagagcccctaggacttccctgaaagcctccccgttcccgggccctctgcagtccctacccaatgccagaactccaggcagtaggctgggctgtcaccctcttctctgagacacctacctcgactcagagacctccccgatgcccttcagatggggaccctccataggccttatttgatgctgtagcgctcttggagcacgcatggtttctgaaggcgtggctcacgtccaggccattctggtgtacattcactgaggacagcttgccctgctccatcattttctgtagagcagggccaagagggggacccaccctcataacagacacaagactcactgccgaaacagctgtcataaaacagcagttctggaaggaaaagaggctttttctgcaaaaaacttctcctccttgtttccaaaggcagggaaagccatcagagcccagctcacctgtggagcccaggtcactatctatccgggatttgtgactggccccttccaccctctcaggactgactttccctccagctgggtaactgggcgcctgacatggcatggcatgtttgtcctgctctggccagttgtggtcgggccaaatgaggtatttccctaggttcctggccttccccttcttgaaaaccatcaggagtgaccacactggaccccagacttgtggggggattcccttgtagatccagtgagaaaaccatggacagaagaaggctttggtgagacaggtctcagggtgatagtaaggaggatcagagtctaagcattctggaagcctcctgcctttggctccaaggttcctcgggggaggtcgagtctacctaggaccgggccttccttccaatgaataaacagtggacaagtgctaaaaaagacaaacaaaaaaagagtgtaactgtgcattttaaaataacatgaacagtataattggattatttgcaactcagtggataaatgcttgagaggaggaatacctcaatctccatcatgtcctcatttcaaattgcaagctgcatcaaaacatgtcaagtatgtgtgcctactaaatacccataaaaatggacataaatgaaacgttaaaaaacaaataaacgacatatatagccgtatatcaattaaaggaattggattcagtaaaagcaacaaagaaactcaacaaagatatttctcaattaaacctcatgtttctggtgacttcactggataattctgccaaacgtttctgggagaaataacaccagttctccactcaagataattgaggagaggccacactttccaaagcattttacagagcaagcacaagcctgatatcaaaaccagacaacattatgagaaaataacatgacagaccaatgtaactcatgaacatagacacaaactctgtaaaaaacaattaaccggagttagaaactagcaacataaaaaatttacatcctagccaaatggaatttcctccatgtgagtttagcaaagtaccatggtccaagatgaccatggaaaagtcaatgctatttttatatgccagcaccaaccaattgaaaatggaaagtcgatatcccttaatatagcagcaaacccccccgtgaaatctgtagtggtaaaatttaacaaaatatgtgcaagacctgtgctcagaagcctaaaaaacatttcagaaaaatatgaaaccacgttgaaataaatagagagacataccacattaatggattgcaagactcaagattgtcaatatgtcagttactcccaaataatctatatgtctagtgtaaaccaataaaaatccctgcagcctcttgttgctataaaatgacaagctgacttcaaaatttatatgggaaagcaaagggactagaatagcctaacaattttataaaggaccaagaatattggaggactcacattacctgatatcgagatgcatttgacaactatgctaatcaggacactgtgatattggcagaagaaaaggcataagagtccgaagctagatctatatattcaagttaaatggatttttccataaagtgccaagagaattcagtggggaaggatgttttattccaggagtggtgctggaacagtcggacattgacatgcaaacaaatgaacctcaaactttgcctcacaccatacacaaaagttaactcaaaatgcttcatagaactaaatgtgaaagctaatgttacaacacttgtagaagaaaatgtaagggaatctgcagcatcgtgtaagataaagatagacaggatgcaaaaagcacaaactatgaaatagaacaaacatacatttttaaaattttatatactacaaacctgtcccttctataccttcacaaaggagaaagaagctttggagctgggaaagcagactattcccctgctctagtagttctcagacaagcttctgtgaaagttagagcccaagatctgttaaaagtgcagattccaggaatcacacccagtgaagcttatgtagtgtggccacaatggtgtcctaggatctgggaattcactgcccagcctagggaacttccagaaactttattaaatcccttaggtagcaagactgtctgaaatatatccactcttcccaggacagacatgaagttgagaagagcgacctcagagcacacagaaacacaggacatgatgaacacagtgtgaaaatcaccataagggtaaggcagtgcgtcttatgagaagacctcacaactcttactggcctttctccccagaggcctcagtttatctcaaatccctgctcctcatgggtggtgaatggagttgtgtcaggaaatgaccttttcgatccccaaaaggcatgggctcctttcaggggccactgaacacataggatggggcatgatgcaagctattgttcccctcccaccagccttggtttccttcttgcaccatcatgtgcttccacgggagcctagagcaatgacacgacttagggccaatgtcttccctttttaggagaccggcccctcgcctgagcagtgcgtctcccctctcctcctttcagctgtccttctcctgatctcatctgccattccacagcagacagctgtccctcgtagcctgatgatctagcctggccccttcctcctatgtcccagcctggagagggctgccctccccgagtggaaggacatcagtcccagggtcccagagccatgactactacagaaccatccttagcatcagtgtcccatggcagtggctgacctttgaaatgaagcttcaccacccatcgcagctggccctgaaacactttcttttctttttgtctcatttgagacaggccctcactgcgttgctcagcctgtagtgccgtggagaaatcatggctcacagtagccttgacctcccagactcaagcaatccttccatctcagcctcacaagtagctggaattacatgcatgctccaccatgcctgggtatatgcttttaaaattttttgtaaaacggggtctccctatgttgcccaggatggtcgtgaactctggggctgaaggaatcctcatgcctcgatgactcaacatgctgagatttgacgtctgagccaccttaccttgccgtgaaccattttctttcttttaaaattactattatactttaagttctgggatatgtgtgctgaacgtgtaggtttgttacacaggtatacacgtgccatgatggtttgctgcacccatcaagccgtcatctacattaggtatttctcctaatgctatccctcccatagacccccatcgcccaacaggccccagtgtgtgatgttcccctccctgtgtccacgtgttctcattgttcaactaccacttatgagtgagaacatggagtgtttggttttctgttcctgtgtcagtttgctgagaatgatggtttccaatttcatccatgtccctgcaaaggacatgaactcatcctttttcatggctgcatagtattccatggtgtatatgagccacattttctttatccagtctatcattgatgggcatttgggttggttccaagtctttgctattgtgaatagtgctgcaataaacatacgtgtgcatgtgtctttatagcagacacactgagtcaggcacaggcagggccgaccagggttttcctggtatccccacacccgaattccagggtgtttgtagtggaaacaaagggacgcgagagcttttgtgtgtgtgcttgtgtgtgtgtgtgtgtatgtgtgtctgtgtgtgtctgtgtttgtgtgtgtgtgtctgtctgtgtgtgtgtcttgtccaaccattctcctgcatccggaaacgttgggaacagagagtcccacgtcacccttagtgcggagtgtgtctcagaaagactttttgtgacagaaataaagaattttatgtctatatttacacatgcctttttctcagggtgtttttctgttgtgaagggtggagggcagtggcatgatcacgcctcactgcagcatccatcttctgggctcaagcaagcctcctcacactgaaacctcccaagtagctgggagtgcagatggccgccaccatgcccacctaatgtatttaattttttttttagatgaggtgtgtcagtgtgttgctcaggctgccttcaaacacacagcctcaagtgatcctcccatcttggccaatttttataaaggctttttatacatgctgtagactcaatcagttcacacttgtgtgcttttttaatattgtgttactccacctttgaacctgtcaactggtaactgatttccatgaaaacctgtaaggtgatcatggctcatcagtcagtgtgatttcagcgttgactcacagcagctaggaaagcctgcatgggaagtatgtcttgaggaaaactggagagtttccaggaacagttttgaaaaacagagactacttatgtcttccttccctcccttgcttctcctcatgtgccaggttttctgctttctccaattgttaacaaatcagcatggagtattatgtgatgaaacgcttttatctctttcatcatcccgtttcttcctcaaaactttttttttttttttctggaagggtggtaggcagaagggactaaacatattcagaaaaacacattgtaatataaatttcgtgaaaaaattcatcatatttaagaaatggtcaggatgaaatcctgaatttgtaataattgtaaaactcagtttgcataacctccaatccttttgtctctatcacttatccggtgagaagtgtagaaaagatgagttccttgcttgtgacagtggcattagttagtcaaactgctgcaccctgtccatcgatatcacacatccagatttaatagccacaaaatgcaaaggcattttacaactgtggcggttttctttatatcattgtaatttccattaaacccctagcactaaattcaatattcacacacttgcaagtaccatggccaagagagatcctgcctgaaatgttgagagggggctgcagcagtggcaacccggctgaagacgaggctggaatgtgtcttcacaaacctgcaaccccttttttgaggcagggtttctctcttttgcccaggctggagtacactggacgacttatagtgcaccacagcgtaggacttctgtgctcaagcgatcctcctgccttacgtttctgagtagatgggactacagacatgtgccacaatgcccaggtaattttaaaaattgtgtagagcaggggtctcactatgttgcccaagctggtcttgaactcctggcttcaagtgattctcctccctcagcctctcaaaatactgggattacaggcgtgagccactgcccgtggcctttttctcacttatttttcctttatctaagttttaaggtttatgtaaggctttgctccagcccaggaaactgaattttttccctcccacttggaggaaacagcaattcaaacgttcaggatttttgacctactgaaagttcattggcaacaattgtgtcctgtctctacctgcctgcaggagaaaacaaaaattaaagtcagcaccaggctgcacttttcctccatacattatcctgtgcagaacagcgtttgagggatccagtgagccagttctcttgcagttggagggattattgttaaatgctgggagtacatgtatttttcataacagacaacagctcggctgttgcttcatactatggggaaatgcatagtctcccaggagtgacagcttcatcatctctaccccttcactcttcctttactcaaagaaagctttcaccatattgtagtgagtcagggtcctgctggtgaatcacacggttgttgacactgtgtcagggacccccaaggccaccctcaccttcagtgattcatggacattctctgctgcccttctgcatacaatactcctaattgaagccagccccctcacctcaggtcagtataccatgcgtcccaccttgtcatgggctttgctcctgtagtgatcactcctctctcctgaaccatcgactgctccctctacattggatcattctccagctacgggaaaactcaccttcttcccccatgtccttctgtagctacgaacacatgtgtctgctgccctgcaaaggaaaactgcatgaacttatgcaacacacttcattggagtccattttcaaaattttctacaaaggaaaatgaaccagaatatctagaacaattctgaagtgtaacttgggggaattcaccccacacaatgtcaagattcacattaattctattttatttattgattgattatgttatcagtgagttggaagaagttgacatcccccttggcttgggggttgatccaatatagagggagccgttgatggttcaggggagaggaatgatcagtgcaggagcagaactcctgaaaaggtgggaggcatgggatcctcagctgaggtgagggtgctgccttgagttaggagcattgaatgaagctattgattatgatttttaatcatccagccccatatggcaattatgttacttctccagtattcaggacagtgtgatattgggggaaaatctacagatcaaaatagagtctagcaatagactcacaaacctaataagttgactttcagaaaagaggcaaaggcaatggacaaagattatcttttaaaaattgtgttattttctcctgcctcgtggccactacattaattgttttttattcctctggtttcctttcctgtgtttctcctttgcacttcaactgctgttctgtttgtctgtctgccccaccacagtgcgatatttcccacagcaaggaccaagtgtctttgtgatatttgctatgtccatctcatcaatgataaaccgaatcaagaaaatgtggtacacatgcaccatggaatactatgcagccatgaaatactatgcagccatgaaatgaatgagctcatgtccttggcagggaggtggatggtggtggcggccattatccttagcaaactaatgcaggaacagaaaaccaaataccggatgttctcacttataagtgggaggtaaatgatgaaaacacatggacacatgggagaaccatcactcactggggcgtactggagtgcgggggtgggaggagggagaggatcaggaagaacagctcacggatactgggcttaatatctgggtgatgtgatgatgtgtgcggtaaatcaccgtggcacacatttacttgtgtaagaaacctgcacatccttcacatgtacccctgaacttaaagtaaaatttggaaattaaaaaaaagtcaatatctcagaatccttatttctatgttttggtctttgtgtcatttatctaagcattatggtgacatgaaagctgaggcataacaacagttagtagattagcaatttagcaggattatagctcagtatgatataacatcaactactagtattgaattgcattcaactccttgaagtgcttaaggaaagttggtaagaaaaagtattcacacttgaaaacatttttaaaattcatgtaaattggattgacactgagtaccacagatgtcactggcactatgctaatgaattacataatagtgtagccagacgagccgcagacaaaacctctcagacaccgagttgtagaaggaagggctttattcagctgggagcatcggcaagctactgtcttaaaatccgagctctccgaatgcacaatttctgtcccttttaagggctcacaacactaaagatttcacatgaaagggtcgtgattgatttgagcaagcaatgggtatgtgacaggggctgcctgcaccggtggtcagagagaaacagaacagggcagggagtttcacaatgttcttctatacaatgtctggaatctatgaataacatcggtttctaagtcatgagttgatttttaactactaggtttaggccaggcaggcccgggtcaggttttgggcctggcgcggggctgcctgtctttggttttacttccttgttgttttttcttaaaaaagatactgaatataaaacaatataaaacaatatgagaggatctctctcttctctcaatagtaaccataagacccagtaaataataaaggagtaaataaaaggagacatatcaaagcatcatcagatgagtgcaggaacacacacatgaacacaccctgcagtcaaactgacaatttaaacatcactgagtgctatttcaagcattatgtagaaagctacagacaacagtgaacttattctgagcatgtcttaatccatcatcttcacagatggctatggaagtggcctgtaaacgttttgtctgataacccctgaagtagtgacgttcaaactcttttatgacaatgtgtgataaatacacagtttatatatagttgactaggcaaataaatatatgtatgtgtataggaatgtgcagtgtatttgtatattctctatgcagtgaacgctatttagtaatttattttacctccattttttaaaatgctgttctttaaaatgctgtttttggctgacaacattaatcttatgatcgaacatggactaaaaactagtttagatggcacatgtatacatatgtaactaacctgcacaatgtgcacatgtaccccagaacttaaagtataataataaaaaaaagaaataattaaagccttttcagagaacatcttggatggttggtaaatgttgctatagaataaatgcaaaaacacattagaacccaattttgtcgccctccttagcaattcagtgcttttagacaaaaatgtcatctttgatatgggccacaaaagccactacaaaatatacaattactgatgaaatatgtgtttcatctgcagatatcagtgtctgttttgcacaggtgaagtcttagttggacagatgggaactcacaggcaaaggggacagaaagtacatgtgacctcttctgttggtatcatgaggaggctttgcttgggctgcagcatagctgaatgtcatgcattgcatgcattcacggagacctccctgtgaatgcacagggacctccattcccttatggtgctccattttatgaggcaagtgggagagctacactgaaaatgttaggtagtaaataatttggcctcaaccaccaagcaatctgaggtcacgtgacagtgtttactctggtaccctgaaacttgccagctgctcagaatctgtagactttgtcccacccccccaccatcctgtggaaatctaagtttggtcgtagattcccatgcatggaggatgggaagctctggtcatgtgggaaattgagccctctcacaggtagactggctgtgttggtcccagctctgtttcctcccttagcagctagagagttgctagggtcatgtatcaagcaactcctcttgtctctacagtgtctttcatactttctgctgcttcctgtttgtcacaagggctccttcacaactttcccaatcccaatactataatgatcctttgaactcattcagcaggtccggagttacagtccacaggaatggcagcaggaagttcaaatttggcaagaaattcaagcctgccctttgaagctggagtgaggccactcaggaatcattaaagtccaggtctgcaggtgatgtttaatattaagtgtcaacttgattggatcaaagggtgcaaagtattgttcctgggtgtgtctgagaggttgttgccaaaggaattctctggctcttaaagaataactgcattttaaagccttcccgcagtgaagccttgaatgactgaatgataaaatggcaagagatcatcagatttctgtggccagtatagcagggagaatgcatgtaggtcagtgatgcttaaggtgggtgtaagatgcttctgctaagcatgctccctgccctcttgtcagtcagtcttcatgagctacttcgtgtaattagattaaagactcatatagtagagtcacctctaaccataccatacattacacattacaggtttctgccttgagacattagatgacagggtttaaagtacaataacagtaatgtgctaattcctgagtggttgacataaatatattttacacatattttccaaattggtgactgttaattagaatacctcttgaagttaaaagaaacactccatgtttaagggagaaattacctaaatgtttttactctcctctgctgaaccattccattagactgtttacgttaaaagatagttctcggacgatttccagcagcctattgaacaagactctgttttattttttgggagatcatagctttaaatgcaaatcttcttaaaataaatagctgattacatgataaaagaaaataatactatgaaataataataaaagagccacagaataaacttaaaggaaaaagaaagaggtaatgaataaaagacagttacaaatcatcagtaaaagaaaaaataattcaaatgtaatgcatttaaaagaatggtcttttgaaaaataggtatgaatagagtattcagtagtttacaccatcttgcagaaaatggaaaaagcacgacatggaatatgaacaagacagggtgatttaatatagggcattattgaaagtgaataaaatcttgaactctaatattttcagagcatgaatgaaatggttgataagctcggaaggcatcccatttactttcagaaactgattttgactttttcagatgtcttactattgttttccatttccatatccctccattttttcgtgtgtggcacagttcataatgctgtcacacattgatgacaaaactgatagtgatagcttaagagtaatgtgaccttatatttaattatacaaatgggaatactttcaagtgtaaaaagaggcatcattcatgttgacatcacggtagaagaaaactgggtacaaacggttactgtaccttaaaaaccacagtagggtaaacgagcccaaataaatatttttgcccttctgcacaatagagtaaaaataaatgcaatgctggcctttctattcacttccctgatgcagttcctaaggtgacattaaccattttcttccaagagagactatttccaggagcccatttggcatacagaccatagattcaagccagaacattaaaaagagtgtttgcaaaagattatacattttacattatacatcaaaaaggaagaaatacatcagaaacaaagaaatgaaataaagattttttctcaaataaatttcacgtttctggtgacttcactggataatcctgcaaaacatttgtgaaagaaataatgttgtttctacacaaactctttataattgaaaagagatcacacttttcaaaacattttacagagtccacatcaacctggtatcaaaaccagacaaacatcatgaaaaaacaacatgacagactaatataactcatgtctataaaagcatagatttatgtttatgctataataatagcaggtcaaaactaggaatatattaaaaatttacaacatcatagccaaatgagattcaccccatgacttgaatatatttatacatgtatatgtgagtttagcatggtaatatgtacaagagaagtttgactttcgcagcaacaaactattgaaaatttaaaatcaatgccacttaatatagcggcaaaatctcatgaaatgtttagtggtaacatttaacaaaatatgtgcaaaacctgtactcagaagcctaaaaaacattgctgtgaaatattaaagcaggctgaaatcagtggagaggtataccacgttaatggattgcaatactcaagattgtgaacatgtcagtttctcccaaatgaactacacattcaatgtaaccacaatcaaaatccatgcaactttttgtttctacaaattgataagctgaattcaaagtttatatggaaaagcaaagggactggaatagtctaacaattttataaagaacaaagaatattggaggaatcgttacctgttttcaagatgtatttcataactgtggtaatcaggacactgtgatattggcataaggaaagaaataagggccaaagctagacctatatattctcgttaatttttttccataaggtcccaagataatttagtgggaaaggatgctgtattcagagaatgatggtggaacaattggacattgacatgcaaacaagtgaacctgaacctttgtctcacaccatatacaaaagttaattcaaaatgcatcatagaacttatcacacttctagaagaaaatgtaggagaatctgtggcaacatgtaaaacaacgatagatgggatacaaaacacacaaactatgaaatagaaaattcataaaatttttaatatttatatatttacatgctatccttatccagtcactaattacttttccaagcattatacaaatcacatgaagaggtcattagacttctgatttcctagagaaatttccatttaaatttttcatacaagctcatgatgatgaaatcccagcattacatttaggctccacaataccctgtaaggagagctgaatatttattatgctcataaaaatatggcctcaccctgcccccacagactcagtccttgagtccctgaagaaatgaagtgataatcaaaagatcatggaaggggtcaaaggtagttgtgacattgtatctctggaacatgctcccagggaaatgtgggaacagcaacaatataaacagcaaaacagtaacagctagaattgattggaaattgaccatatgccagggactttcctgacaaccgtacatgttttcttcacacactcagtgctctaaactgccccaagaactacataaatttactagtagtatttctatggtactattggagaaaggagtcacagagatgttaagtaactttctcagtgtcaccagcactgagtggtggaggcacaggtcagaggcatcatggaaaactctattgtgctgcatatttgtgcaagggtaagatctgaagggtaagagccaaaggctatagcaaaatatttagaattttatagcatgggactgcacaggcaagagacatttgatttcttcagaaatagttaagagatggagacttgaaaggattggcctgggtatgatttggagacagtgccctgagtgtgtcattaccataacggcagcatgtcttcacctgaagatcttgggtttgtacatcagagaacacaaaaaaacctgtcccttctataccttcacaaaggagaaagaagctgtgcagctgggaaaggagactactcccctgctctactagttctcagacaagtttccatgaaagttggaatccaggatcctttaaaagtgaagattccatgattcacacccagtgagtctcatgtagtgtggtcggaatggtgccctaggatctgggaatttactgcccaggctagggaagtttcagaaaactgattaaatcccttaggttgcaaaactgtctgcaatatacccactcttcccaagacagacatgaggttgagaagagagacctcagagcacacaggaacacaagacatgatgaatgcagtgtgagactcaccataagggtagggcagagggacttttgagaaggcctcacaactccatctggcctttctccctgaagacctcagtttatctcaaatcccttctctttgtgggtggtgaatggagggaatgccagaaaataaccctttagattccaaaattgcatggacttccctaagggaccagtgaacacataagatgggaggtgatggaagctatcgtgctcctcccaccagccttggatctttctggtaccatcgtgtccatccatgggagcctagagcaatgtcaggacttagggcaaatgccttcccttcagtaacagacacctgcacctcctctgaggaggttgtctcccttctcctcccttcagctgtccttctcctgatctcatctgtgatcccacagcagacagctgtccctggtagcctgatgacctagcctggcaccttgctcttgtgtcccagcctggagagggctatcctcatcaagaaggacatcagtcccaggatctcagagctatgactaccacagaaccatctgagtattaatgttcatggcagtgattgacctttgaaatgaagcttcaccacccatcgcagctggccctgagacactttcttttatttctgttttatttgagatggggtcccactctgttgctcagcctggattacagtggagaaatcatggctcactcccacgctcaagcgatgcttccatctcagcctcccaagtagctgagactacaggcatgctccaccatgcctggctgtttttcaaaatttttagtagaaaaggggtctccctatgtcccccaagctggcgggagccaccacgcctatccctgaaccactttcttatcacagaaagcaaagcaagacagaggaggaaggtgcctgtaacccctcccagggacattgtgtcctcctccttggtgccctgttatttcctttgtaccgaccacaatatccctactctttttatgtaaacaagaagtttgaggatacttcttttcaatcataaacttgtggcttatagccagaatatcgttacctactgggccattttggacttttctgagtgcagctgtggttgttggaatgattggtaggggctgctggcatttggggaatgagtgttacagggaggcaaacatctttttccaaagtcttccataaactggattttccatacatgtcacttccctgtaaactgagggagacttgtatgttgcttcatctaagaacttataaagacttattgactgcttcagaaatcacatcactgcagggcattccattcttagattgcactccaacacaacattccagcatcagttttctttgtatctgtgcattcctggggaaaatagaataaggggaatccaacatacctacgaacacgatcatttccatgataagctctttgttgatggggaaatttatgtgggagatgttggtagtgtgatctctcatgagttggtgaacacactggctatgcccgttgctgttaccgctgttgcaggtgtatctccctcaccaggctccaaagtccttcttggaaggatggaaacatacccagtagatctctgtgccctcaggatggaacagaggacctcacatgcagaaggagggcagagaacacttgtagaattgtagtgacctctacatggttagatgaccaaaccctgagtcgcagtgacgagcagcatggatgtcagtgcatgggaggggaacaccacaggcctctgcgtttggagccatgcagcagagtgagatcaacctgcagtatcgatctcagttatgcactttaagggccccaaatataagcagcctattggttagggttcttctgtgtgtgtgtgtgtgtgtgtgtgtgtgtgtgtgtgtgtcgtggggtgggctgtgcacccaagtatttatgtgagtgagtagagagagagagagaaagattgagtttgaagacctagctcatgcagctgttgtgaccgggaagtccaaatctcgcagagcaggatgtcaggctggagacccggggaagagatgatatgagagctcaaatccaggggcagtgtggaggcagaatttcttcatcttgtggagaaccgcagtcttcttctctgaaggccttcaaggaactggatgaggcccacccacactggagagggcaattgggtttactgaaagtctgctcatttaaatgttagttctcctaaagaaaacccttcacagagcatctaccctggtcaaagtgaacatttctcatgcattgtggcgtagcaaagttgacacatcagctttcccatcatagccatcttatacaaatcctaataatgatgaaggcctatctgacaaaggcaggtgacttcctaactaagattctgtattatccatttttgtccaacccaagccagcatttcagggtcataacaactctggccaggaagccgaagctgatgtgaatgccttccagggatgaggcagtggtgggatagtcagggcatacaggtaagaacaatcccagagggcacaggtgatacccctggacaccaagagtttacccttgttaaggcacccccagcaggacatacagtcatcaggcaggagctggccaaggcccccaatgtggcctcccactgagggacctttccctctagggttctttgtccagtccaaacaattgatttgcatctttcatttagtggaactatcagcaggcagtcagttcagagtagtcattgacactagttcttcctattcacaagtgtgaatgacatccctaggtgttctatgtgggatgttcagcagctgggtcacccctgctgcccaatggtcacagctcggtcagatgtaagtttgggttcaggattcagtgtggtttcaaaattggccttaggttttgactgtgggctcctcacaggcagagagacccaccatctgtgctgttactgagtatctccaattcagtgtagtactgtgggagtagcgacacagtgttgacacaatgccgatcttgcttttgttccgtctgcaagtaatcaaccatttcgatccatttggcctcattgtcttcttacccaccaaatctatgaatatatgacaagacaaaataacaaccgcactggcgatccttgtgtccctgttagccaccacagggctgcttagggactgcctgagctcttgacacacgatgatattgagttgtgtggtgttgactgactggagtagacttattcttcatggcttcacacacaccaaacaagttttcagcacgtactactgacttagtgttggccttgtcacacctcggttatttacaaatcaacttcaaaagcaatgccatgtctgataccagctacaactgctatttaatttacatatttacatcaaatcagtttctgaagtcaaatgcattttaaaaggtagactaatattcctacttgaaattccaaagcacttatcacatactagagatgtagttgtaaaaaaaatgtgaaattttaaagggattaaggaaagataactagtaaatttatctgcaatgtaatgcctgcatcttatgttatttcatttattcttcaaagcaagtatttagtctaaatattctaatttctactttggaaatggggaaacagtcccacaggatgtaagtatcttgcccaacatcacaaggccagtgtttgagaggcaggatggacacccaaggctatgccatgccattgcctgtaaggagacagtgtaggtaggatccaagtaattttgcttcagcaaattgacctagtcgctttcctttttcttctgcctaggcgctagttctttcatccagctctatagtctagggaattctcacatatcttgtggcaaatgggatatcctaacgaaggatgcagatacagagatacacaggggaaggaatgaaggaagaggcagggggcttccatgccctctacgggcatgctaccctccatgtgttccgctaggcagaagctctatgaaccctgtccttttgggttttgatggaggttttcattataaaggcatgattgattaaactgttggcccgccattggcaatcaacttaaccttcagcccctctccctgtcctgaaggttggggatgcagctgaaagtgcgaaccctctaagctcccatcctagagctacctaggagctgccagccatcagtcaactcactagcatacaaaaagacgtcgctatgaggcgattctaaaacctgtaggagctgtatgacagtaagcagggtccaggaccaaatatatatatttcacaatatcacacatgtgtataccagctcaatcagaatgcaaagttgcaaaaatgatactatattttattcagacagagtcgcattcgcccaggctggagttgcagtggtgtgaacatgactacctgcatcctcgacctcctagactcaagggatcctcccatctcagcctccagagtagctggaactacacctacaaacatacatgcatacattcatgcattcattcatttatttttgtagagagggggttttgccatgttgcccaggcatgtctcactctcccaagctcaagcaatccccttgcctcagcatcccaatgtgcttggattacaggcatgagccactccacccggccaaaatttacaatagggtctaatatgcgagaataaatgaacaaaagatgtgtgatacttatttggagaaaactggaaatctttattgagatttttaaaagtcaaatatctcggataaatccagtttgcattctttcagcttgcctttgtttaaagctgtggttgcccttcccctgcaatagaaacacaacaggaaggaacattactagcagaactgtattcagatgaaattaaaggtatacaaaggacaccaaaattttagttttatacattggacaaaaaccagaagcctaagtaagagtcaccctatggctaacattccactagacctctgtagagactttgaacataacacctccaagcatacacattaaacaacattttttaaacacaccccgcttttggtgctagaaggaaaccaaaagacagtctgagaccagaacacattaaatcaagtgaacctattaaaaggggcttaaagtagatagcaaacattgtgtagagttttactcaaaatgcaactaaaacacaaaaaacctaagcaaccgaaggaatttgtgaaaaatatataatttaatgttttggcttgaaactatcacctggatgtccaataggctcctgcaaatagtctgagaagtatgttttgccataatgtaactgaaaacagttatgatacattaggaaatacgtaagtgaagtgaatagaaggtccagtattgcatttgttttttgtctattgtgcagaagtgcaataatattgctttgggctagtttacccttcttagtccttttttgacatacactaaccatttgcatccagttttcacctatagtcattatgtcaatatgaataatgatacatttttcaccggaaagtattcccatttgtataattaattaaatggtaatataagttttaagatatcactgtcattattgacattaaaacgtgaaacagttatacatcataagcaatgtggcaaagaaaaagaaatggagagggaaacaaaatcggagagtaacacatctggaaagctaaatatttgcttctaaaagtgactgtttttggctgggcgcagtggctcacgcctgtaatcccagcactttgggaggccgaggcaggcagatcaccaggtcaagagatcaagaccatcctggctaacacggtgaaaccccgtctctactaaaaatacaaaaaattagccaggcgtggtggctggtgcctgtagtcccagttgctcgggaggctgaggcaggagaatggcatgaacccgggaggcggggcttgcagtgagccaagattgtgccactgcactgcagcctgggcaacagagagagactccatctcaaaaaaaaaaaaaaaaggtgactgtgttttgaggtacaactggcaaatttcacgtccttccacagtctttgtgatgttcagatattcaggtatttcagggatatattaaatagtgtaggcattctgagcatatcaaccatatcatccacactctgaaaacattagtgttcaagaatgtattccctttcaattatgccctacattcaatatctgtgtcttgttcatattctgtgttgtgccttttccattttcttcaagattgtttaatctactggatgctcttcctagctatttctcaaaagaacattctattaaatttattaatatcaaattagttttccttttgttaatgatgcatacctttcatttactgcctttttcccttaagtttattctgtgactcttattattttgctctttcttaatattattttcttgtatcatggaatttgctatctattttaataagatatacatttaatgctatgactgtcctaagaatacaactgaggcttgttcagtagcctcctggaaatcatctgaaaacaatcttttaatgttaatagcctaatggagtggttcagaagtgtggagtaaaaacatttaggtaatttctcccctaaacatgcagtgcttcctttaaattcagaagttcttctaattaagtcagcaatttggaaaacatgtgtaaaagatacttacgtggactactcaggacttagtatgttatagtctttgaactttaaatcgtatcttctgatgactcaaggcagaaacctgtaatatataacctctgatatggttagaggttaccatatgtgtcttcaatctaattatacacagtagctcatgaagactgacaggagggcagggagcatgcttagcccaggcatcttacaaacaccttgagcatcactgacctacatgcatgctccctacttcttgggtcacaaaaacttgactgtctctttccattttattattcagtcattcaaggtctcactgcgggaagactttaaaatgcaatcactgggtccagcaagggaggtggctcatgcctataatcccagcactttgggaggctgaggcaggtggatcacttgagatcaggagttcgagcccagcctggccaacatggtgaaactctgtctctactagaaatacaaaaattagtccggcgtggtggcacacacctgtattcccagctacacaggagtctgaggcatgagaatcccttgaaaccgggaggtggagatcacagtgaaccgagatcagaccactgcactccagcctgggcgacagagtgagacccctactgaaaaaaaaaaagcaatcattgtttaagagcctgagagaattcaggatttgacaaaatccaagaacactcatgaaggtctccatacaggaaaacaaacatcaagtagagtgccagctcatttacttaggagcaatgaaatctcaactcggatattataattggactgaagctgatggttatgataaacaaatcacgaaaatgaaattatctttgtattttctccaacagaaccgaaacatgcagaaatcagcaatgaaatgattttaatctatctgatgtgcattcactactttcaataaaagcaaaaaccggtgcaggatttatgtgttttgtccagaatctcacaaattatcttagagctggtattagaatcttcttcagggtcagcatatttcatacgaagtggtattacaaatgtattatgtatttgtgaaaagcagaaagtagaaaataatctacaaatttttagctgttggttatactcagaagtaagaaaatgcttttcttttcttttcttttcttttcttttttcttttcctttcttttttttccccccgagatcggagtttcactctgttgcccaggctggagtacagtggcatgatctcggctcactgcaacctccacctcctgggttcaagcagttcctctgcctcaccatcccgagtagatgggattacaggtgcctgccatgaagcccggctaattttttgtatttttagtagagactgggtttcaccatttgccctggctggtctcgaactcctgacctcaaattatccacccgcctcggcctcccaaagtgctaggatgacaggcgtgagcccccgcttctatttgatgattcaatatggctttgacccagtttgtgtctgtatctgatagtctttcagttttgcagtcaggcttctggggtctcgactaccttcccgagaaagtctgcatttggactctgtttttaaaggggcagtaatgttctctcttttcattatcaaaagtgtaatattatggaatacagaaagcacgtaattttgaatcttaatggataacatacctccttctggcattttaaattgctctcattttgtcagaatcttccccctggacaccagggccaactccacattcatccccagtctttgactgagacagcttctggagatcagcttccaggtcaggtactaaaaaataccaaggatatcgactggagcagccaaaccagaatgataaataaggaaatgatcctattcttttcctcagtgtgatgcaataaaagcctgtaggctactgtggtaataaatgtgatgcaaagatgtccccgtttgttttcctgtattatgatatcttaactaacaatctgaggataaatcacaccacacctacatttcccatactttttaacattgtgtgttataaacactcagctacctaggaaatctgaagtatctcagctacctaggaaatctgaagactgccccgtggatagcattttaatcataccttaaatataatgttctgaatgattagatcaatgtactggtctgcttatgacaaatcttatagtcctgacactaattccctgttcaggtaccctgaaagtgttggggttaaacttaattaatgtttaggtccaaaggccctatatgtcattaagaaaaagtacctgatacaacagcaaaaccactgtcttccaatgagagtacgggaactgaagtgcagagaaattaatgggcattgttgacagtcatattctggaaaccccttaacagtgaattgctaaaataatccatggcccaaattctgtctatctttagttcgaaagtgctatctattcgttgaggaaacaatttctgtttcacgataatcttattgtacttggagttttctaattataaaaatattgaaacaacttttaaaagccccttcaaagtcctactgatatagttatctgtattccagtgtcctgaattatccaccttttaccaaacatactgtcaaaaataggcatcagaggaaacagtggctgtcatttattggcctcttttctggagacgctatcctacttcactgaactgcgttttgtcctgagtcaatgctgagtaccttacagtgcagacatatttgagtattaagcatttttaagcaaaatcattcacattttctgacatggatggtgggaagaatgcaaaccttggaacaaaatatgaattcctcctccatgagtcaagtgttcttggtaagtctcaatctctgagcctcatttttctgttatttatttatttatttatttatttatttatttattgacacagagtttcattctttttgcccaggctggagtgcaatggtgcagtcccggctcaccgcaacctccacctcctggattcaagcagtttctctgcctcagcctcccgagtagctgggattgcaggcatgtgccaccacgcccggctaatttttgtatttttagtagagacggggtttcgccatgttgcccaggctcgtctcgaactcctgaactcaggtgatccacccaccttggcctcccaaagtgctgggattacagatgtgagccactacgccttgtgcagcaaggggcatgcacactgagtcaggcacatgcagggccggccagggttttcctgctatccccacacccttatcccaggtagtttgtagtaggaagaaagggacatgagagattttttaaattttttttgtctcttgcccagccattctcaggcatccagaaacattgagaacagagagtcccatgtcacccttagtggagggtgtgtctcagaaagaccttttgtgacagaaataaagaattttatgtctatatttacacatactgttttctcagggtgtttttctgttgtccagggtggagggcagtggcatgaccatggctcactgcagcctccatctcttgggctcaagcaatcctcctcacacagcaacctcccctgtagctgggactgcagttggccgccaccacgccctcctaacgtatttaataattattatattttagatgcggggtgtcactgagttgctcaggctgctttcaaacacatggcctcaagtgatcctcccatgcctgccaatttttatacatgctgtagacaatcaattcacacctgtacttttttttaaggttgtgttattgcacttttatacctcttgactggtagctgatttccttgaatacctgtaaggtaatcaccggctcaccaatgaatgtggttttaacaatggctcacagtggcttggaaagccctcatgggaagtatttctgaggaaaagtggagagtgtgcaggaatagttttgaaaaacagagacaaccgatgtcctccttccctcccttgcctctcctcatgtgccaggttttctgttttctccactattacagaatcaccatgttgtatcctgtgatgaaaagtttttatctctttaatcatcccatttcgtcctccagacctttttttttctggaagggttgtaagcagaagggacgaaacatcttcagaaaaacacattatgatataaacttagtgaaaagattcatcatatttaagaaatggacaggatgaaatcctgaattcataaaaattttaaaaatcagtttacataacatccatcccttttgtctctatcccttatccagtgagaagtgtagaaaagatgaattcctcacttgtggcaactgcattaagtagtcaaactgctggaccctctccgtcagtatcacacatccagatgtaatagccacaaaacacaaagacattttacaactgtacctttttttttatctcattgtaatttccatcaaaaccctagcactgaactcagcattcacagagttatgattccatggccaagagaaatcctgcctcaaatgttgggaggaggctgcagcagtggcagtccagctgaagacaaggctgaaatgtgtcttcacacaccccactccctttttgagacagggtttctctctgtcatccaggctggaatacactggaggacttagagctcaccacaacctaggagtcctaggctcaagcaatcctcctgtgttaccttcctgagtagatgggactacagacatgtgccatgatacccagctaattttaaaaattgtgtagagcaggggtctcactatgttgcccaggctggtcttgaactcctggcttcaagtgattctcctccctcagcttctcaaaatactgggattacaggtgtgagccactgccagtggtctttttttctcactttttttcctttatctaagacttaagttttatctaaggctttgctttagcccaggaaactgattttttccctcccacttagaggaaagaacaattcaaaccttcaggatttttggcctactgaaagttcattggcaacaattgtatccagtctctacctgcctgcaggagaaaacaaaaattaaagactgcgctttccccccatatattatcatgcacagaacagcagttgagggatccagtgagccagttcccttgcagttggagggattattgtgaatgttgtgagtacaagtatttttcataatagacaacagctcagctgctgcttcatactatggggaaatccatagtctcccaggagtgacagcttcctcatctctaccccttcgctcttcccttactcaaagaaagtttcaccatgttgtagtgagtcagggtcctgctggtgaatcacacggttgctgacactgtgtcagggacccccaaggccaccctcaccttcagtgattcatggacattctctgctgcccttctgcatacaatactcctaactgaagccagccccctcacctcaggtcagtataccatgcctcccaccttgtcatgggctttgctcctacagtgatcactcctctctccagaaccatcaactgctccctctacattggatcattccccaagctaagggaaaactcaccctcttcccccatgtccttctctagctacgaacacatttaattcctgccctgcaaaggaaaactgcatgaacttatgcaacacacttcactggagtccattttcaaaattatctacaaaggaaaatgaatcagaatatccaaaacaattctgaagtttaactttggggaattcaccctacaggaggtcaagattcacattaattctattatatttattgattgattatgttatcagtgcattggaagaaggtgacttcccccttggcttggggattgatccagtatagaaggagccgttgatggttcaggagagaagagagatcagtgcaggagcggagcccctgagaaggtgggaggcatgggatcctcagctgaggtgagggtgctgccttgagttaggaagcattgcatgaagttgttgattatgattcttaatcatccagccccatatggcaattgtgttacttctccagtattcaagacagtgtggtattggagaaaagtcaacaaatcaaaatagagccagcaatagactcacaaaacctaataagttgattttcagaaaagtggcaaaggcaaaggagaaagattacctttttaaaatattgtgttgttttcccctgtctcatggccaatatattgttttttattcctctggttcccttccctgtgtttctcctttgctcttctactgctgttctgtttgtctgtctgccccaccacagtccgatatttcccacaacaaggaccaagtgtctttgtggtatttgagatgtccttcccatcaatgataaactgaatcaagaaaatgtggtacatatacaccatggaataccatgcagccataaaaaaatgagatcatgtccttggcagggacatggatggtggtggcagccattatccttagcaaactaatgcaggaacagaaaaccaaataccggatgttctcacttataagtgggaggtaaatgatgaaaacacatggacacatgggagaagcatcacacactgagcctactggactgcgggggtgggaggagggagagggtcaggtagagtagctcgtggatgctgggcttaatgccagggtgatgtgatgatgtgtgcagtaaatcacagtggcacatatttacctatgtaagaaacctgcacatcctgcacatgtacccctgagcttaaagtaaattttggaaataaaaaatgtcaatatttcagaatccttctttccatgtgttggtcattgtgccatttatctaagcattatggtgacataaaagctgaggcgtaacaacaattagtattatcagtaattttccaggattataccccagtatggtctaacatcaactactaatattgaattgcatttgactcctggaagtacttaaggaaagttggtaagaaaaaatattcatgcttgaaaatatttttaaaatttgtgtaaattggatcaacactgaataccacagatgtcgctgtcactggatgctaatgaagtacataataggaactataagacacagtcaataataaaggggcaaataaaagggaacatatcaaagcactgtcagacgagtgcagaagcacacacatggtcacacctgcagctgcagaaagacatggtaggaagtaaagccccacaactcatcagccttccttctcaccagctcatgagttcacaaatgagtttgctgagggtcaaatgcccacagtaaaactgaccagtttaagcatcactgagtgccatttcaagcattatgtagaaagccacagacaacagtgaacttattcttagcaaatcttaatccatcatcttcacagatggctaaagaaatggcctgtaaacattttttctaataaccactaaagtagtgacgttcaaactcttttatgacaatgtgtgagaaatacacagtttatatatagtcaactaggcaaataaatatacgtttgtacatggggatgtgtagtgtatttgtatattctatatgcagtgaacgctatttagtaatatattttatctccattctttaaaatgctgtttgtggctgacaacattaatcttacaacccactatggattaaaaaccagtttagaaatgattacagcttttcagagaacatcccccatggttgataaatgttgctatagaatatatgcaaatatgcatgagaacccaattttgtccacctcctttgcaattcagtgtttttagacaaaaatatcatctttgttatgggccacaaaggctactacaaaatatacaattactgatgaaatatgtgcttcatctgcagatatcagcgtctgttttgcacaggtgaagtcttacttggacagatgggaactcacaggcaaaaggaacagaaaatacatgtgacctcttgtcctcttgatatcatgtggaggctttgcttgggctgcagcatagctgaatgtcatgcattgcatgcattcacagggaggtccctgtgtgacctccattcccttatggtgctccattttatgaggcaagtgggagagctacactgaaaatggtaggtagtaaataatttggcctcaaccaccaagcaatctgaggtcacgtgacagtgtttactctggtaccctgaaacttgccagctgctcagaatctgtagactttgtcccacccacccaccatcctgtggaaatctatgtttggtcatagattcccatgcatggaggatgggaagctctggtcatgtgggaaattgagccctctcacaggtagactggctgtgttggtcccagctctgtttcctcccttagcagctagagagttgctagggtcatgtatcaggcaacgcttcttgtctctgcagtgtctttcatactgtctgctgcttcctgtttgtcacaagggctccttcacaactttcccaataccaacgcaattatgatcctttgaagtcatccagcaggtccggagttatggcccacaggaatggcagtgggaagttcaaatttggcaagaaattcaagcctgccctttgaagctggagtgaggccactcaggaatcattaaagtccaggtctgcaggtgatgtttaatattaagtgtcaacttgattggatcaaagggtgcaaagtattgtttctgggtgtgtctgagaggttgttgccaaaggagattaacatttgagtcagtggactgggagaggtagacccaccctcaatctgggtgggcaccatctaatcagttgccagcagcactagaataaactaagcagaagaacatggaaaactagacttgctgagtcttccagcctccaacttctcccgtgctgcatgcttcctgtcttcgaacatcagactccaggttcttctgcttttggactcttgaatttacaccagtgatctgctaggggatctcgggccttcagccacagactaaaggctgcaatgctggcttcaatacgtttgaggttttggaactcagactgccttttttgctcctcagcttgcagacagcctattttgggacttcgccttgtgattgtgtaagttaatactccttaacaaaccctgctgcacatacacatctatccatcagttctgtcctttacagatccctaactaatacagtgtgaaacagtaaaatctagccatctgatggctgcacatcctgcacatgtaccccatttttccaatcacagtattctgatttttgttttgttttgatttgctatggtttggtttggtttttttgagagggagtcttgctcttgttgcccaggctggagtgcaatggcgtgatctcggctggctgcaacatttgcccctgggttctatcgattctcctgcctcagcctcctgattagctgggattgcaagtacccgcaccatgcccagctaagtttttgtattgttagtagagacgatgtttcaccattttggccaagctggccttgaactcctgacctcaggtgatccacccacctcggcctcccaaagtgcacactattctgtttgcagactgaaatatgagttggcgaggaagatgatatagaccaagacgatgtttacgacttgctcagctgattgggcctatgcttgtgagtgacttaacatttgatgttttctattagcagaattttttttgtgtgatagtgttgttgaattagtatagatgcaatgataaaggtctcccatgttgacaaaaaaccattgcggcatctcatgaaggaaacagtaacccaagaggactacatactggtttttcctggatgtgggaatttgtgttccccagatttgactagtgatttcctcctcatgcttattcatagctcattacactagcacatagctagtgttgcagcatgtctttaaacatgcatatgatcagaagtatctatgtaatctgtatattcgtattattgacatgcattgataagaaaaattttttatctgcacgcgcacacacaaaaccctcttttcccaggagcccagtgtgccagagcctcaacaagaagaaccaccagcttaaagttgggatcgtacacctggtcagaagacagaagaagatcagggtgcagctgagattcaaggtggtgggaagggaaagaaagaatgtctatgggggggaggagacctatgtgtgcatcatgccttatgccatgaccagtaagaggaggaaagaaaacactaggaaaggatctcaaacatttgctgagggttggctggaaacgtgacgggtatagtttgcagcttcctgcagtccctggatatgattaatcttctctttttcttcgagatgcattttgtgggcttgaaaatacagtccttcctaaatcagatgaaaccatttaattggttgtataaaaatgtacattatttcactagtttaacttgatattcttaggatgttgcagtgagatcttctcagccatggtgttcacagtgttttaagcaccctttaatagcatgtggagtgccaagtcgccctaccttataataccctgaataaagcccatttgcaaagggatgttaacctcattttataaataaaactgaggcccggtgtggtggctcatgcctgtaatccctgtgctttgggaggccgaggcgggtggatcacttgaggtcaggagttcgagaccagcctggccaacatagtgaaaccctgtctctacgaaaaatacaaaaattagctgggcatggtggcacacactcataatcccagctgctaagcaggctgcagcagaagagttgcttgagcccgggtggcattggttgcagtgagccaagattgcaccaccgcactccaacctcggtgacacagcgagactccgtcttgaaaaataaaaataaaaataaaaaaataaataagaaaactgagaatcagaggttgagacttaccaagaacacgactcatggagaaggaattcatattttgtttcaaggtttgcattcttcccgccttctgttttagaaaatgtgaatgattttgcttaaaaatgcttaatacttaaatgtgtctgtactataaggtaatttggtattggctcagggcaaaacgcagttcagtgaagcaagatagcaactccagaaaagaggccaatggatgacagccactgtttcctttgatttatatttttgaccatatgtttagtaaaagctggataattcaggacaatggcatacaggtaactgtgtttgtaggattttgaaggggcttttaaaagttgttctaatatttttataattagaaaacttcaagtacgataagattatcatgaaacagaaactgtttcctcaacagatagcattttcagactaatcagagacagaatttgggccatggattattttagcaattccctgttaaggggtttccagaatatgactgtcaacaatgcccattaatttctttgcacttcagttcccatactctcactggaagacagtgattttgctgttatattttgtattttttcttaatgacattcatgtatggaaagtcacatatagggcctttcaacctaataattactttaattaaggttaacaacaacattttcaagatacctcaacaggagatgagtgtcaagactataggatttgtcataggctcaccaatacattgatctaatccttcagaaaattacatttaagttatgattaaaatgctatccacgaggccatcttcaggtttcctaggtagctgtgtgtttataatacacaatggtaaagtatgggaaatgcaggtgtgctgagacttatcctcagattgtcattaaaaataagatatcataatacaggaaaacaaacggggacatctttgcatcacatttattaccacagtagcctacaggcttttattgcacaacactgaggaaaagaataggatcatttccttatttatcattcttgtctggctgctccaatcgatttccttggtattttttagtgcctgacctggaagctgatctccaggagctgtctcagtcaaagactggggatgaatgcggagatggtcctgatgtccaggggaagattctgacaaagtcagagcaatttaaaatgccagaaggaggtatgttatccattaagattcaaaattatgtgctttctgtattccacaatattacacttttcataataaaaagagagaatattactgcccctttaaaaacagaattcaaatgcagactttatttgtaaggtggttcagaccccagaagcctgactgcaaagccgaaacactatcagatacagacacaaattgggtgaaagccatattgaaccatcaaataggaaagcattttgttacttctaagtataaccaacagctaacaattttcagattactttgtaatttctgtttctcacaaatatataatgcatttgtaataccactttgtatgaaatatactgatctctgaaggagattctagtaccagctccaacacgatttgtgagattctggacaaatcacatcaatcctacacccatttttgcttttattgaaagtagtgaatgcatatcaaatagattaaaatccatttcagtgctgatttctgcatgctatggttctgttggagagaatacacagatattctgattttcatgattttttcatcataacaatcagctttagtccaattaaaatatctgagttgagatttcattgctcctaagaaaatgagaaggcactctgcttgatgcttgttttcctgtatggagaccttcatgagtgtttttggattttgtcaaatcctgaattctctcaggctcttaaacaatgattgcattttttttttcagatggggtctcactctgtcacccaggatggagtgcagtgttccgatctcggttcactgcgacttctgcctcccggattcaagcaattctcatgccttagcctcccgtgtatttgggattacaggtgcctgccaccatgccaaccagtttttttatttttagtagagacgaggtttcaccatgttggccaggctgggctcgaactcctgacctcaagtgacccactcgtctcggcctcccaaaatgttgggagtgattacaggggtgaacctcctcctgcgccagacccaatgattacattttaaagtcttcccgcagtgaagccttgaatgactgagtaataaaatcgatagagacagtcaggtttttgtgacccatgaagtagggagaatgcatgtaggtcagtcatgctcaaggtggttgtaagatgcctgtgctaagcatgctccctgtcctcctgtcagtcttcatgagctactgtgtgtaattagattgaagacacatatggtaacctctaaccatatcagaggttatattacaggcttctgccttgagtcatcagatgatatgatttagagttcaaagtctataatgtactaagtcctgagtagtccacataagtatttttcatacatgttttccaaattgctgacttaattagaagaacttctgaatttaaaggaagcactgcacgtatagggaagaaattatctaaatgtttttactccacactgctgaaccattccattcgactatttacattaaaggatagtttacagacgatttccaggagcctattgaacaagcctgaattgtattcttaggacagtcatagcattatatgcgtatcctattaaaatagacagcaaattacatgatacaagaaaataatacttagaaataaaaaaaagagtcacaagagaaacttaagggaaaaggaaacaggcagtaaatgaaaggtacgaatcattaaccaaaggaaaagtaatccaaatgtaataaatttaatagatcgttcttttgtgaaatatctaggaagagagcatccagtagcttaaacattcttgaggaaaatggaaaaagcacaacacggaatatgaacaagacacagatattgaatataaggcatgattgaaagggaatacattcttgaacactaatattttcagagtatggatgaaatggttcacatactaggaacacctacattatttaacatatacctttaatacctgaatatctgaacatcacaaagactgtgcatgagcttgtgaaatttgctgttcgtccctcaaaacagttacttttagaagcaaatatttagcttttccagatgccttactctcagttttctttccctcttcatttttttttgccatactggatatgatgtataactctttcacattttaatatcaatcatgatcgtgataccttaaaacttatatgaccatttaattaaaactgaagcccttactggagtagagccaattaccctgttatgccctccacagtggaagaagctctccttaaaactgaatctgcaacagagattcccttataaaatggtcttcccagactccagctaaaatcaaccctactggagtgtcacatcccatgagcaaatagccacatgccctgcccataaggctaacttgccaaaccccagaaatggcttcatcccttgctcaaggggagccagagggaggaaggccagcactcaaaaaacaagagaagcaatgctttttttcctctcccaagtatattacctagacaatggagatataattagcaaatccctgtagttattttttatataataacctacgacaggatataaacttaaaaccacatttatcctgagtaggatccactatagttacaggtttggtgattataggaaatgtcaagacattagggaaattgaattttccttgcaggatccatgaacatcttcaaccaaagcagaaatagcctaatcagaagagaggtgagggttcaggtcaccaagtaaggttcagttgatttggggttggaggagcttcaaatcttctaaatcttcgcataatatagccctgataatttaaatgagacagtgcttcataaacttggttgaaataagaatttcaatggagtcatagtttatttaaaaagaaaaatttacctccaaggggcagatgaaagagtcagtgttcctcttctgactgaaggagaaaactcacaaatgtgagtttaatgtacatcttaaaagaaaacagaagctgtgatcggtggttcacatgtataatctcaacactttggaaagcagaggcaggaggatcgctttaactcaggagttcgagacatgttgtctgtcatatgtgggagctaaaaattttgatctaatggagtagaattttggtgaccagaggctgggaacagggggtgggtgggatgaagcgaagttggttaatgggtacatacaattaagtaaaaggaataacttctatttgatagcacagtagggtgactaatggtaacaataaattatcatatatttcaaaatggctagaagggaagatttgaaatgttcccagcacaaataaatgataaatgtttgaggtgatggatatcctaaataccctgatttagtcattgtcctttgtatacatatatcaaagtgtcacatgtaccccataaatatgtacaacaatgtatcaataaaaaagaaataagtaaacaaaatacaatctaatttacattggtgtatgtatacacaatggaatactattcagtcatataaaagaatgaaatcccatcatttgaggcaacatgtatgggcttcagatgtgtgagcctggaggacattaagtgaaataagccagacacagaaagataaatactgaatattctcattgatatgtggaagctaaaagcttttatttcatagatgtagagagcagaatagagaatagtagactctgggaagggtgggagatgaacaggtagagtttagctaatggatacaaaattaagactaaataggaggaataatctctagtcgtctatttagcactgtagggtgactatagttaacaataatctattgtatattttcaaatagctataaaagaggattttgaacatttccaacacaaagaaatgctaaatgtttgaggtggtggatatgctgattatcctgatttgatcattacaagttgtgtatgtgtatcaaaatatctcactgtaccctgtaaatatgtacaattattatgtatgaataggatatatgtacacacacacacacacacacatatgtcctcatttactaacaaaaagcaactagctaatcaaggcccccttcctctccttccctttcctatatgacctaccacgctcataagttatctaaaagtaagtaatgagaactgaaaccacacacacagcttactgcctatatgaacaagagtttactattccactggcttcattaacataacattattactacaagaatctcttgcctgggaagataaaagttgaacataactttattattgattctaggaactgcttaaaaggcctatccactgttcagtaaaaagtgccaaatgacaaacccacagccaatatcatactgaatggacaaaaactggaagcattccctttgaaaactggcacaagacagggatgccctctctcaccactcctattcaacatagtgttggaagttctggccagggcaatcaggcggcagaaagacataaagggtattcaattaggaaaagaggaagtcaaattgtccctgtttgcagatgacatgattgtatatctagaaaaccccatcgtctcagcccaaaatctccttaagctgataagcaacttcagcagtctcaagatacaaaatcaatgtgcaaacatcacaagcattcttatacaacaataacagacaaacagagagccaaatcatgagtgaactattcacagttgcttcaaagagaataaaatacctaggaatccaacttacaagggacgtgaaggacctcttcagggagaactacaaaccattgctcaatgaaataaaagaggatacaaacaaatggaagaacattccatgctcatgggtaggaagaatcaatgtcatgaaaatggccatactgcccaaggtaatttagagattcaatgccatccccatcaagctaccaatgattttcttcacagaattggaaaaaactactttaaagttcatatggaactaaaaaagagcccgcattgccaagtcaatcctaagccaaaagaacaaagctgggggcatcacactacctgacttcaaactatactacaaggatacagtaaccaaaacagcatggtactcttaccaaaacagagatatagaccaatggaacagaacagagccctcagaaataatgccacatatccacaactgtctggtctttgacaaacctgacaaaaacaagcaatgaggaaaggactccctatttaataaatggtgctgggaaaactggctagccatatgtagaaagctgaaactggatcccttccttacaacttatacaaaaatcaattcaagatggattaaagacttaaatgttagacctaaaaacataaaaatcctggaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtaaacaggcaacctacaaaatgggagaaaatttttgcaatctactcatctgacaaagggctaatatccagaatctacaatgaactcaaacaaatttacaggaaaaaaacaaacaaccccatcaacaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactggaaactggtttaaccgttgtggaagtcagtgtggcgattcctcagggatctagaactagaaataccatttgacccacccatcccattactgggtatatacccaaaggattataaattatgctgctacaaagacacacacacacatatgtttattgcggcactattcataatagcaaagacttggaaccaacccaaatgtccaacaacgatagactggattaagaaaatgtggcaaatatacaccatggaatactatgcagccataaaaaatgatgagttcatgtcctttgtagggacatggatgaagctggaaaccatcattctcagcaaactatcacaaggacaaaaaaccaaatattgcatgttcttactcataggtgggaattgaacaatgagaacacatggacacaggaaggggaacatcacacaccggcgactgttgtggggtcgggggagcggggagggatagcattaggagatatacctaatgggtgcagcacaccaacatggcacatgtatagaaagaaaagtactgtatgatctcacttatgtgtggaatcagaaagaaaggtggggggagaaagaaagagaatgagaaagggaaaaaaggaaagaaagaaggaaagaaagaaggaaaggaaggaagaagaaagaaagagagaaaaagaaagaaagaaagggcaagcaatagggagatagaagaaagagcaagcaatagggagatagagaataaattggtggtgatcagggacaggggaggatagaggaggaaatggggagatgaaggtccaaggatacaaagtagcaggtatgtaggatgaacaagtctagagagctaaggtacaacatgaagattgttgctattatattaggcactttgattaaataagtagattttagctgttcttgtcacacaaaagtcactgtgagatgatataataggttaatttccttcactacattagccacattactatctttatgtaacccataccatcatgttgtaaacctcaaatatacacaatgattttttttttaaagggacaaggttttcgaagcaatcagggtttcttgccaacgaagatgcccccaggcctccgtggattcctccagtcttcctcatgaatgccagatggtggtgtgcaggaaaaagctggcaagtgaatgtggattccacttgtgtctgagactttctgggattccagctctcccaattgcctgtgtttggcctttatgaatttgttacattttcaattacttccttcttatcccctcttatgactgtcacttcttccacatgtgctctgccagaggtgatgcagtttgtgtgtctcatctcccctcagagagactagccacccttggtatcagttcccatggctgccttgttaccccagctaatttatttttatttttttgtagaatcaaggtctcactatgttgccaggactggtctcaaactcctggcctcaagcaatcctctgacctggcctcccaaagtgctgggagtacaggtgtgagccactgtgccgggctttttgctcaggttttaatcagattatttgttttcttactgttgagttccttatatattttaggtcttcaccccttctcagatgtatggtttgcaaatgtattctctcattccataggttgtctttgcacactgttgattgtttcctttgctctgcagaagtttctgagtttgagataatctcattcgtttacttttgcttttgttccctgcactttggggattatatccaaaaactaattgcccagaccagcgtcatggagctttctccctatgttttcttctagtagtttcatagattcaggtcttacattatacaatgttaattcattttaagttgacttttgtatatggtgagagatgaggatggaatttcagtcctctgcatgtggatatatcattttccaaatacaatttattgaaggctgcccttcccttactgtgtgttcttggcacctctgtcaaaaaccaattgaccgtaagtgcatggatttacttctgggctctctattctgttcctttgggtcacatgtctattttggggatgccataatacttcagttctctttccggatttatattcctcaattttattgtccttgcttctctctgtcagttttcatgtattccttagctttgctctatattctttcctttggagaattgatccatcattataagtttaggtgttagaagttacggggaggcaaaaggatgctcaatagcctcttccctcaaaggatatgcaatttggttaaggacacatataaattaattaaagtttttctttctttgtttttgagacagggtctggctttgtcacataggctgcactgcagtggtgtgttgctacttcactgtagccttgagctcctgggcacaagtgatcctcctacctcgacctcccatgggaactgggattaccagtgtgaaccatcaaaacaaaacaaaacaaaaacaagtgtgaaccatcaaacccagcccagagacatgtaaatttatcattataatttttaaaattgcataattcaatttaatgttgtcataatttttttcaaaggaattgcgtccggagaaatttattgtttttaagactaaaatagtcattaaaaagatggatgctggctgggcacggtggctcacacctgtaatcccagcactttgggaggccgaggcaggcaggccacttgaggtcaagagttcgagatcagcctggccaaaatggtgaaacctcgtctctactaaaaatacaaaaattatccaggactggaggcaagtgcctgtaatcccagctactcaggaggctgaggcaggagaattacttgagcgtgggaggcagatgtttcagtgagctgattgcgccactgaactccagcccaggcagtagagtgagactgtcttaaaaaaaaatggatgctaaaaaaagaaaaaaacttaaaggcagaattaacattttggattaaaaatcaaagtacatgaggggatagattcctcatttgccctgatgggattattatgcattgtatgcctgtttcaaaatatctcatataccccataaatatatacaccttactatgtactcataaaaattaaaaattaaaaaatagaaaatttgcctgtgtttggcctttatgaatttgttacattttcagttcagaaaaaattctgagaaaaatcaaaaagaagaaagtaatgttcactttttgagggacaaagtttctcttaattgttaactgcttggagttacataatttagccattgctaattctatggtgttttcattccaattttaagtttaaaaatttcattaattatgttatccagtgggtctgaggtagaagaatcaatgttgttgatgctgctttcacagcaaagggactggttccagagtcattatagtggagaagattgggagttagtaaaggagccaacctaagtaagttttggacaaaaaaaatacgaaaatagccactttctgaacccctaaatgatgatagatgaggaaatatttggaagaggctaaggtaaatttacagatgacagactgctaaacggctactctaagaagcaaagatatcctctggcattcacattgatggacttttgcttcttgtctgatgactgagcaccatgattatttccctttgctgtaatgatgaaagaaataaagataaagatggtattgatgtcgtgaaatactattacagcaaatattgtagccttctttctttcacagaaagcagcattcattaactttcaccaagaaaaatggaaactaaggtcctctctatcctccacccctaaatgatacctaaaaaggaaaactgacataaccaagtgtgaccttaatagtgagtgtcaagttgattggattgaaggatgaaaattattgatcctgggtgtgtctgtgagggtgttgccaaaggagattaacatttgagtaagtgggctgggaaaggcagacccacccttaatctgggtgggtaccacctaatcagttgtcagtgcggctagaatataaagcaggcagaaaaatgtgaaaaggctagagcagtctagcctcccagcctacacctttctctcatgctggaatcttcctgcccttgaacattggactccaagttcttcagttttgggactcagactggctttccttgctcctccacttgcagatggcctattgtgggaccttgtgatcttgtgagttaatacttaataaactcatatatatatatgtatatatatgtatatatgtggatacatatgtgtatgtacatatatacgcacacacatatataggagatatatatatatacatatatatataggagctatatatatatatatctcttattagttctgaccctctagagaaccccagctaataggccaagaaaatgtattcaagatagcacactgctatttattttatcaaagatttgtgatagtatattctctctgagggaatttaatattgattttcctgatgtaaaataatatttcttttctgattaaaaaagtagtagatgctttttatagaaacttgtaaaatatggaatagcagaataaacactaacaaccacaatttctccagtctgaggtaaacaatgtgttgcacttctatccagtaccttttataactgatgcaactcttaagttgtatacatatatcaaaacatcacattgtaccccataaatacatataatagttgttaattaaacaggttttaaaaaagaaaaaatagtaagtcaacaaccttcgaacaatatatatacagaaaaattagtctttatataatatgtagagttgatattcttcacacagacaaaaaaactcttgaagtgaaaaataaatttaaagcactacataagtaacaagatgaataaataacacaataaaataaaaaattagtactaaaacaattcaaagtacaaagctatggaaataattatgcaatctagtaattttagaatgaaaaataaggcaaaattgagattaaaattttctccatcaaagtagaaaacacttaattttttaaaaacaaggaatacagtgaagctgatcctggaaaaggtcatgttggtagggaagttggattcccatcattctttcccccaggcatgcacaacgacaaagtaaactgatattggactgttgtgtcagagcagaatccaggaatggaatgccctgcagtgatgtaattttccaaagcagtcaataaatctttataagttcccagatgaagcaacataccagcctccctctgtttatgatttgtatatggtgagagatgagggtcaaatttcattcatctgcgtgtggatgtacaatttctccaataccatttattgaaagctgccctccccccactgtctgtgcttggcatctttgtcaaaaatcaatagagcgtaagtgtgtggatttatctctgggcttaatgatttttcattactcttttctttactgatgctgagcatgtaaaatttaacaataacaaataaattcatgataagaaatctaacaaatctgactttctcagttacactccacttgaaaacacatgaggtttgtctgtttgactagtacttcctttcctggtgaggttcagcaatagatgaactttgtgagcttcagtgactacttcctacctttccaggtaattgtaagaataaaataaatgatagtgacaatagtagtgaagatagtattaaaataaggctgggcttgttggttcatgcttgtaatcccagcactttgggaggccgaggcagaaggatcacttgagcacaggagttccagaccagcctgggaaaaatagtgggatgtcccatgtcaaaaaaaaaaaaaaaattaaaccattagcctggtgtgctgttacatgcctgtactaccagctaatagggagggtgacatggcaggatcccctggagcccaggagttgcaggctgcagtaacccacattaacatcactgcgctccaacctgggcaacagaatgagaccctgtctcagaaataaaaaacggtattaagataaagctaacagcaatactattatgggctgaattgtgtctgctcaaaattcatatggcgaagtcttaacccctagtgcctaagaatgtaactgtatgtgacataggtggggtctttaaagaggtaattaagagaaattaggtcattagactgggccctaaggcaatttgcccagtgcccttataagaagaggaaatgaggacacagacacacgtacagagggaggactaaggcagacacagggagaaaacagctgactacaaggcaaggaaggacgccttagaagaaaccaactctgctgacaccttgatctcagacatgtagcctccagaattgtgagaaaatacatttctgttgtttaagccacccagtcggtggtagttattgatggcagccctaacaaacgaataaaaatccttttagtgcccctcaggaggtgagcattatcatatctattttatgaactagcactactgctcctcctactaatttaatgaccgcataatgatgcctgtatctgagcaactgagcagtgataagaaaacttcaaaaccttctgaattattttaccttaagtccatgaccacgagagaattttctccctttcatgctcttcctacttccactactacaatactctcacaaaatgccaggaaccctcctccatttgaatgacctctcctaatgattcattcagaagacagaagcaatctgctgggaactcttagagcttcccaaacccagtctacctgtgctgttctggcattctctgcggcccttctgcatgcaattgctcctgactgaagccagcccctcacctcagctcaggatcacataacttccactttcccaggggctttgatcctgcaatgatcacttctgcccctgaaccatcaacggctccctctatactggattattccccaagctaaggaggaactcaccttattcccccatgtccttctgtagctactaacacatttatctgctgcccttcacagcaaaacttcatgaacttatacaacttcacttcattggagtccattttcatccattgctctagtttcagaaaaccacaggccttttccacaacttagggtacagctgttatcctaacttgttataaaactgctcactgctttagggtatggctgtgagctcctcacaggcagagagacccaccatctgtgctgtctgtcactgagtacctgctattcagtgttgtattatgggactagggacacggtgcctacacaatgctgctcttgcttttgttgtgtctgcaaacaatcaactacttggatccatttgggctcattatctccttattgaccaaatctatgaatatgttacacggcaaactaacaactgcagtggtgatccttgtggccagggctgcttagggactgcttgagcacttgacacactactgtattgagttgtgtggcattgcatgcccagaatattgatttattcttcatggcatcgcacacagcaaacaagttttctgcacggacaattgacttaggtttggccttgtcacacctcagttttttagaaatccactttagaatcgatcccgtgtctgacaccagctacactgctaattcattaacatattcattgaaatcaaataattttgtgaagtcaaatgcattttaaaaggtaacttgacattcctacttgaaattcaaaagcagatatcacatacaagagatgtagttttaaagaaatatggaaggaaaaagtttgaaatcttaaaggaaacaaggaaatctagtaaaccaaatttaactgcaaagcaatgcctacttggtatgttatttcattgattcttcatagcaagtaattagtgtaactattgtaatttctactttagaaatgaggaaatggtcccaaatattgcaagtatcttgcccaccatctcaaggccagtgtgtgggaggcaggatggaaacccatggctaattcatgccatagcctctaaagagacagtgtaggtaggacccaagtcatcttgcttcagcaagttgctctggttgctttcccctttcttctacctaagccctaattcttccatccagttctacagcctaggaacttcttacatattttgtggcaaattggatatcgtaacaaaggaagcagatgaggagacacataaggtgaggtacgggggaaggggcagggagcttccatgccctctatgcgcaagctgccctccatgtgttcagctagagggaagctctctgaaccatgtccttttcggttttcattatgtaggtgtcattgattaaactgttggcccgccatttgtgatcaacttaaccttcagcccttgtcccttccctgaaggttgtgggtggggctgaaaggcccaactctcttcttccccaacctagagctacctaggtgctgctagccatcagtcaattcactagcatacaaaaagacaccactttgtggagattctaaaaattgtaggcgttgtatgcctggaagcagggtctagaaccaaatatgtgtttcacaatatcacacctgtgcataccagctcaatcacaatacaaaatttcaaaaatgattcttaattttttttgaaattgagtctccattccaaaataatttaaccacatcctggacctcttgggggcccaagaggtcccaccttaacctccagattagctgggactacagctacatacatatatgcatacattcccaccttagtctccagagtacctgggactacagctacatacatatatgcatacattcatgtatttattcttttattttttaaaaaagggggtctctttctgttggccaggttggtctcatctcctgtgctcaatcagtcctcctgcctcagcatcccaaagtgctgggattagaggcttgagctaccacatcaagccacagttttcaatagtatcaaatacctgggaataaaatgaacaaaagatgtgcaagacttttttggtgaaagttgcaaaactttattgaaatatttttaattcaaatatctctaatataaaaccagtttgtgttgtttcagcttgtcttcgtttaaaactgtggttgcctttctcctataatagaaacataaaagttgggaacattactaggggaattatattcagatgaaattaaagatatgggaaggacaccaaaatcttagttttatacagtggacaaaaaccagaagtctaagagtcacccttttgcttacattgaggtagacctctgtagagacttcgacgataaacatccaagcatatgcattaaaaacatttttaaaacacaccctgctttctagtcctgcaaggaaaccaaaagatagtccaaggtccgaacatgtgcatagttttactcaaaatatcagcaccacacaaaatacctaagaaactaaaggaatttacaaataatgtgtactttttctgtaaacttgcttttaatgttttggcttcaaactacggtctggatgcctaataggctcctggaaataccctgaaaagtatctttggagaaatcagttaatgtcacattaggaactgcatacaatatggtgaaagccttgtttgaataaaggaagagtgaaggggtagacatgatgaagctgtcatgcctgggagaccatggatttacccataatatgaagcagcagccgaagctgttgtctattatgaaaaatacatgtactcacagcatttaacaatagtccctccaactgcaagagagctggatccctggatcccttaaccactgttctgctccagataatatatgggggaaaggtgcagcctcatgctaatgttaatttttgttttctcctgcaggcaggtagacaaaggactcaataattgccaaagagctttgcacaggccaaaaatcctgaacatttgaattgctctttcatccaagtgggaggaaaattatcagcttcctgggttggagcaaagcctcagaaaacccttaagccttagattttaaaaggcgggtaaaagtggctgcatgcactggctcacaccaggaattccagcattattggaggctgaggcaggagaatcacttgaggccaggagttcaagaccagcctggacagcatagtgagactcttgctctacacaatttaaaaaattagctgggcatggtgacacatgcctgtagtcccatctattcaggaaggtaaggcaggaggatcactttagctcaggagtttcatgtcgtagtgagttgtgagtcctccagtgtactccagcctgggcaacagagagaaatcctgtctgaaaaagggtggggggggttgtgaagacacattccagccttgtcttcagctgggcgcccactgctacagccccctcccaacatttgagccaggatctctcttagccacagtacttgtaactctttgaatgctgaatttactgctaggagtttgatggaaatttcaatgagatggatgaaatcagggaaagttttaaacaggccttgcattttgtggctattacatctggatatatgatattgatggaaggtggccagcagtttggctactcaacgcagcagccacaaataaggaattcatcttttctacacttctcactggataagtgatagagacaaaagggatggaggttatgtaaactgatttttacaatttttacaaattcaggatttcatcctgaccatttcttaaacatgatgaatcttttcactaaatttatattataatgtgtttttctgaaaatgcttttgttccttctgcataccacccttccagaaagaataaaaggtttggaggaagaaacgggatgattaaagggataaaaacttttcatcacagaatacttcatgctgattttctatcagctggaggaaacagaaaacctggcacatgaggagaggcaagggagggaaggatgacatcggttgtctttgtttttcaaaactgttcctggaaactctccacttttcctcaagcaatacttcccatgcaggctttccaagctgttgtgagccaacgttgaaatcacactgactgctgagcccatgatcaccttataggtattcagggaaattagttaccagtcgagagatttaaatgtgtaataacacaacctaaaaaaaagggtagaggtgtgaattgattgagtctacagaagtagttaaattcattgtacacatggttgaaaacccagaaccagataaggaagtgattaatcaaagcatgtataaaaattggccaaaatgggaaaatcacttgagcccatgtgtttgaaagcagcctgagcaacacagtaacaccctgcatctgaaaaaataattaaatacattaggtgtatttaattatatatcatattatattcaaaatacatgaggggaacacccatacatgagaaagaagatacaaacacatctgcacttatagtaggagatttcaacatttctctcagcaattggtagaaacagtgtacaagaaaatcaggatatatatatatatatatgcagaaggcttgaacaatggtatcaaccaactcggcctaattgttatttatagaacaacaacagaatatacattcttcacaagtgcacatggaatgttcaccgagatagaccttatttatgggccaaaaaacaaatctcaacaaattctaaaggaatgaaatcttacaaaacatgttttgtgaccacaaaagaattgaaatagaaattagttgtagaaagatatacggaatccctgaaatattggaaattaaacgacacttttaagtaacgcagggatgaaagaataaattgtagagaaaatttgaaaatgaaaacacagcctatcaaaaaatgcaagataacacagtaaagcagtgcacagagggaaatttatagcattcaatacttatatcagaaaggaagaaatgtctcaagtcaattacctaagcttccacattaagaaactagaaaaacagttggccgggcatggtggctcacgcctgtaatcccagtactttggtaggccgaggcaggcagatcacaaggtcaggagttcaagaccagcctgaccaacatggtgaaaccctggctctactaaaaatacaaaaattagctgggtgtgggggcacgcacctgtaatcccagctactcaagtggctgaggcagcaaaatcgcttgaactgaggaggcggaggttgcagtgagccaagatcgtgccattgcactccagcctgggtgaaggagtgagactctgtctcaaaaaaaaaaaaaaaaaaaaaaaattagctgggcatagtggctgaggcaggagaatctcttgagcccagtaggtggaggttgcagtgagctaaggtcgtgccactgcactccagtctaggtgacagtgccagactgtctatgaaaaaaaaaaaaaacctaaacaaataaataaaataagaaactggaaaaataaaatcaaattatacccaaaacaacaagaaggaaaaattaataaagatatgaatagaaataaattaaatagaaatgaaaaaatctattaaaaaaatcagtgaaaccagaagtcgcttgtttgggaggaacagtcaaattaataaacctttagacagactgatgagagaagtggagagagaatacaaatcacagatatcagtagcgccagagggcacatcaatacaaatcattcagatattaaatatatgatagggaacatggtgaaaagcactatccaaaatattattttttaaatggagtgggaagattccttgaaggacactagctagcaaacctcattccccccaaagaaatagatgacatatatagtgtttataccaattaaagaaattgaattcactaaaaccaacaaagaaatgaaacaaaatttttttctcaaataaaattcatgtttctggtgatttcactggttaattctgcaaacatttgtggaagaaatagtatcaattctacacaaaccctttatgataattgaaagagatcacacttttcaaagcattttacagagcccacatcagccttatatcaaaaccatacaaacattatgagaaaataacatgacagactaatataactcatgttcataaaagcatagatatatatatatgctataataatagcagttcagaactaagaatgtattaaaaatatacaacatcatggccaaatgagattcatcccatgacttgaatatatatacatatgtgagtttagcaaagtaatatggtacaagataagtatgcaaaagtcaatgtgatttttaaatatcatcaacaaataattgaaaattgaaaatcattaccacttaatatagcagcaaaaatccatgaaatatttactggtaaaatttaacaaaatatgcacacaaactatactcagaagcctaaaaaacattgctgtgaaatattaaagcaggctgaaattaatggaaaggtataccacgttaatggattgcaacactcaagattgtgaataagttagttactcccaaatgaactatacattcaatgtaaacacaatcaaaatccttgaagccttttgtttctacaaactgataagctggccttaaaatctatatggaaaagcaaagggactagaatagtctaacaattttataaagaacaaaattattggaggactcagtacctgttttcaagacgtatttcataactgtggtaattaggacagtgtgatatcggcatatgaaaagaaataaggggccaaagctagacctatatagtcacgttaaattgattttttccataaggtgccaagataatttagtgggaaaggatgttgtattcagagaatgatggtggaataattggacattgacatgcaaataagtgaacctcaacctttatctcacacgatataaaaaagttacctcaaaatgcattatagaacttaatgtaaaagctaaagttttgacacttctagaagaaaatgtaagagaacctgtggcatcgtgtaaaacaaagacagataggatacaaaaagcagaaactaagaaatagaaaattcataatcttttaaatatttatatccttatgtgctatccctatccagtcactagttacttttccaagcattatacaaatcacatgaagaggtcattagtgttccgatttcctagaaaaatttccattcgaatttttcgtgcaagctcatgatgatgaaatcccagcattacatttaggctccacaataccctgtaaggagagctgaatattcattatgctcttaaaaatatggcctcgccctgccccacagactcagtccttgagtccctgaggaaataaagtgataatcaaaagatcatcgaaggggtcaaaggtagtcgtgacattgtatctctggaacatgctccagggaaatgtgggaacaacaacaatataaacagcaaaacagtaacagctagaaatcattggaaactgacaatgtgccagggacagtcctgacaactgtgcatgtcttcacacagtcagtgatctaaactgccccaagaagtagatgcaattactagtagtatttcaatggtactaatggagaaaggaatcacagagatgttaagtaactttctcagtgtcacccagcagtgagtgctggagccacaggtcagagacatcatgtaaaactctactgtgctgcatatttgtggaatcaagagtaaggtccaaaggctattgcaaaatatttaggatttcatagcatgagactgcacaggcaagagacattcgatttcttcggaaatagttaagagatggagacttgaaaggatcggcctgggtatcatttggagatggtgccctgagtgtgtcattaccataacaggcagcacgtcagtgtcggtctcctcacctgaaggtcttggatttgtacatcagagaacacaccaaacctgtcccttctataccttcacaaaggagaaagaagctgtcttgctgggaaagcagattattctgctctgctactagttctcagacaagtttccattaaggttgcaagccaggatcctttaaaatgaagattccacgattcacacctggcgaatctcatgtagcgtggccacaatggtgtcctaggatcttggaatttactgctcaggcttgggaactttcagaaaccttattaaattgcttaggtagcaagactgtctgcaatatacctactcttcccaggacagacatgaggttgaggagatcgacatcagagcaaagaggaacacaggacaagatgagcgcagtgagactcaccataagggtggggcagacagacttttgagaaggcctcacaactccatctggcctttctccctgaaggcctcagtttatctcaaatcccttctcttcatgggcggtgaatggagggaatgtcaaaaaataacctttcagattccaaaatggcatgggctcctctcagggaccattgaacgcataggtgggaggtgttcccagctattctgctcctcccaccagccttggattctgcttggcaccatcatgtccttccatgggagcctagagcaatgtcaggacttagggccaatgtcttcccttcactaacaggcacctgctcctcaactgcagaagttgtctcccttctcctcctttcagctgttcttttcctgttctcatctgtgattctacagcagacagctgtccatggtagcttgacaacctagcctggcaccttcctcctgtgccccagcctggagagggctgtccttgccgagaaggacatcagtcctgggatctcagaactatgactaccaaggaaacatcctgagcatcaatgtccaatagcagtgattgacttttgaaatgaagcttcaccacagaccccagctggccctgaaacactttctcttatttttgttttgtttgaaatggggtcccactctctttctcagcctgcggtgcagtagagcaatcatggctcactcctaggctcaagtgatgcttccacctcagcctccaaagtagctgagactacaggcatgctccaccacgcctggctgttttttttaaatttctttaatatggtggtctccctatgttccccaggctggcttgagacaccatgcctatccctgaaccactttcttgtcactaaaagcaaagcaagacagaggagggagttgcctgtaacccctcctggagaacattgtgtcctcctccttggtgccttgttatttcctctgtactggccgcaatattcctactcttttgatgtaaataagaagtgtgaggatacttcttttcaatcctaaactcatggtttatagccagaatatcattgtctactttgaaacattttggttgtttccgagtgcagctgtggttgttggaatgatgggtaggagctactggcatttggggactgagcgttacagggaggcaaagatcattttccagagttttaagtaaactagattttccatacatgtcactcccctgcaaactgagggaggctggtatgttgcttcatctggaaagttatgaaagacttattgactgctttggaaaatcacatcactgcaggccattccattcttggatcccaccctgacacaacattccagtatcagtttgcttagtagctctgcatgcctggggtaaaaatgaagggaatccaacttacctagcaacagtatcttttccaggataagcttcccggcacaccccagctggccccaaaccacttgttgttgctgtttcagaccgggtctgtcactcagcctggaatgcagtggaaaaatcatgactcagtgcagccctaacctcccaggctgaagtgatccttccatctcagcctcccaagtagtttcactacatggaggctccaccgcccacggccaattttttttttgtagaggtggggtgtccttatgttgcccaggctgatctcacactcctgggttcaagcaatactcactcctcaacctctattagaggtaggagccacctcacctatccctgaacgactttcttatcacagaaagcaggacagaggaggaaggtgcctgcaaaccctcctggggaacattgtgtccttctccacgctaccctgctattttctctgtaccaacggcaacattcctattcttttgatgtaaataagaagtttgaggatacttcttttcaatcctaaacttgtggtttatagccagaatatcttcggccactttggggcattttagaaatttctgagggcagctgcagtttttggaatgattggcaggtgctacttgcatttgggtactgagtgttacaggcaggcaaacgtctttttccagagtcttcaataaactggatttcccatacatgtcactccctttaaactgagggaggcctgtatgttgcttcatctgggaacttataaagccttattgattgcttcgaaaatcacatcacagcaaggcattccattcttggatttcactctgacagaatattccagtatcagtttttttgtatctgtgcatattgggggccaatagaataaggggaatccaacttacctacgaacatgataatttcaggataagctgttagttgatggggaaacttaagtgggagatgttggtaatgtgatctctcatgagtttgtgaacacactggctatgccccttgctgttactgctgctgcaggtgtatctccctcaccaggctcctggctccttcctggaagactggaaacatacccagtagatctctgtgtcctcaggatgggacagaggacctcataggcagaaggagggcagggaacacttgtggaattgtagtgacctctgcatggttggatgaccaaaccctgagtcacagtgatgagccacatggatgtcagtctgcagagggtgggaggggaacgcaacaggcctctgccttagaagccatgcagcagagtgagaccaaccttcagtactgatctcagttatgcccttcaagggtcccagatataagcaccctatttgttagggttcctctgggtgtgtgtgtgtgtgtgtgtggagagagagagagagagagacgggggagcggttttgaagacctagctcatgcagctgttgcgactggcaagtccaaatctcccagagcaggatgtcaggctggagagccagggcagaggtgatatgagagcccaaatccaagggcagggtggaggcagaatttcttcaacttgaggaggaccccagtcttcttctctgaaggccttcaagggactggatgaggcccacccacattgggtaaggcaattaggtttacttgaagtctgctgatttaaatgctagttctcatgtaaagaaaacccttcacagagacatataccctggtcaaagtgaacatttctcatgtatcgtggcctagcaaagttgacacatcagatttcccatcacagccatcttatacaaatcctattaatggtgaaggtctatctgacaaagacaggtgacttcctaactaagattctgtatttttgtccagcccaagccaccatttcaggctcagcacagctcttgccaggaagctgaagctgatgtgaatgccttccagggatgaggcagtgatgggctagtcagggaatacaggtaagaacaatcccacggggcacaggtgatacccctggacaccaagagtttacccttgttagggcacccccagcaggacatacagtcatcaggcaggagctggccaaggcccccgatatggcctcccactgagggacctttccctctaaggttcctcgtccagtccaaacaactgatttgcatctttggtttaggggaactgtcagaaggcagtcatttcagggaggataagtctcagcacacctacatttcccatactttaccattgtatattatacacacacagctaccttggaaatctgaagactgccccatggataacattttaatcaaaacttaaatgtaaatttctatgattagatcgatgtattggtgggcctaggaaaaatcttatagttctgacactcataccctgttgaggtaccttgaaaatgttggggttaaacttaattaaagtaatgcttaggtccaaatgcccttcatgtaactttccatacatgaatgtcactaagaaaaatgtatgcaatgtaacagcaaaatcactgtcttccagtgagagtatgggaactgaagtgcaaagaaatcaatgggtattgttgacaggcatattctggaaaccccttaacagtgaattgctaaaataatccatggcccaaattctgtctatctttagtttgaaaatgctatccgttgaaaaaacaatttctgtttcatgataatcttatcgtactttgagttttctaattataaaaatattgaaacaacttttaaaagccccttgaaaatcctactaatatagttacctgtatgccagtgtcctgaattatccagctttttaccaaacatactgtcaaaaatacacctcaaagaaacagtggctttcattcactgccctagtttctggagttgcttcactgaactgcattttgtcctgagccaatagtgaagtaccttacaatacagatgcttttgagtattaaatatttttaagcaaaatcattcacattttctaacatagatggtaggaagaatgcaaaccttggaacaaaaatatgaattccttctccatgagtcaattgttcttggtaagtctcaatctctgaggctcagttttcttattcattttttattcatttatttatgtatttattttgaaacggagtctttgtcacccacttgctctggagtgcagtggcacaatcttggctcactgcaacctccgtcgcccaggctcaggggattctcctgcctcagcctgcttaatagctgggattacgggggtgtgccaccatgcccagctaatttttgtattttcagtagagacggggtttcaccatattggccaggctgatctcggactcctgacctcaggttatcccgcataggcctctcaaagtgctgggattacaggcgtgagccactgcgctgtctggcctcatttttcttatttataaaatgaagctaacatccctttgcaagtgggctttattcagggtgttataaggtagggtgacttggcactccacatgctattaaagggtgcttacaacactgtggacagcatggctgaggaggtcacactgcaacatcctaagaagatcaaattaaactagtgaaataatgtacatttttatacaaccaattaaatggttttatctgatttaggaaggactgtattttcaagcctacaaaatgcatctcgaagaaaaagagaagaatcatcatatccagggactgcaggaagctgcaaactatgcctgtcacctttccagccaactctcagcaaatgtttgagatcctttcctcatgttttctttcctcctgttactggtcatggcataagccatgatgcccatataggcctccttctcccaataaacattctttttttcccttcccagcaccttgaatctcagctgcaccctgatcttcttctctcttctgaccaggtgtaggatcccaactttcagctggtggttcttcttgttgaggctctggcacactgggctcctgggacaaggggtgtgtgtgtgcgcatgcacacgtgttcgtgtgtgtgtttgtgtgtgtgtgcgtgtgtgtgtgcaaataaaaaatttcttatcaatgcctgtgaataatatgaatacagattacatagatacttctaatcatatgcatgtttaaagacatgctccaacactatcccaacactattccacatacttattcttcataaagttactcttcccatagagaggttactctaagactgttaccctcaacagcttgggtagccatttttatttatgttgggttgaatgtgtgtaatgctctatgaataagcatgaggaggaaatcaccagtcaaatctggggaaaacaagttcacacattcaggcaaaaccaggatgtagacctcttgggttactctttccttcatgagacgccacaatcactttttatcaacatgggagaactttatcagtgtatctatactggttcaacaacactaccacaaaaagaaattgctcctagtagaaaacattgaatattaagtcactcataaggagaagcccaatcatgtgaagaggttgtaaatattactttggtgtaagcctatatgttgatcttcctcaccaactcatatttcactctgcaaacagagtactgtgattgggaaaatgcacttgagaggatagctatatttgtccacatccgtggacaaatgttaacttgttttttttttgaagaatggaaatactttgaaagtatgttttagagcagttataagtgtgtgagccttctgaatagaatgcttgcacaatcatttaagttggtcaagctagttgagcaatgtcttaaggcttctggcaagagacacacagtatttccaatcaggtttggtttcacaactggactttccattgtggagacatttaagtttacacacctagagaattaaaattggagtgaccactgctttcatcacacacccattttctaggcccattttacacctcccccaaaatcaagtttcattggaatgcacagccctgcccattagaaactccagggtggagttgagaagctgtcacacagcactgggcgctccttactggacacctttatcagaagctctgcagaccttggagccatggtcattagcctgcagcgttccgagtttccaggctccttccttagtgcccacgccaccctttcgtgggtccccaccgaggaatgtggaatctgtcctctgtcgggggttccaggcccttctggcactcagatacccacaacagcacccccatgttcacctgaccccacatcccctgtctgcagccttccttcctccctcattctgacactccccacaatagggcccatggcggcgcccccacaagaggaggacgatgaacttgaaactcttctccctgtaagccagggaccacatcacccgacccttccaaagcttactgactcctcctcacactcattcacacttcaacttctgggaggactggcctgcagacctaccagctgagtctcagtaggggagaaagagtccagactgctggaacggtgacctttacaccttcacagcttccccgcgttcaccacgtgggtgaaggggcccacgggaagacacataatgaacatgtgccctgaggccagcccccaagaagcatgcacagtgagattggtgcctgccttgtgggctctggtgacccacctcacaatactctatcccccgctgccgtcctctgctctctcccaggtcccaaatgagcatttctgaatctgtcctctgtgagcagtttcatatgcctctggtactcaaataacacacatagtttccctgctcaaaactcactctaccaggagtttgagactagcctgggcaacatggtgaaaccccttctccactaaaaatacaaaaaattagctgagcatggttgtgcctgccagcagttccagctatgtgggaggctgaggtggaaggatcacctgagcccaggaggttgaggctgcagtgaaccatgatcatgcccctgcactctagcctaggtggcacagtgagaccctgtctcaaaaacaaaaacaaacaacaacagcaaaaatactccatgttcacttgacattcctcccctctatggccctccttactcccgcgtctgggctgcccatgacaccaagcccatggctgcatcactgcctgttaggagaaggataaggacctcaaggcccttctccctaggaagccatggaccacacccacgggctcctcctcacactcactcacacttcaactttctggtaggattgacgtgagcatctaccgacttatttgtagttggtacaacagaaggaagtcacgacatctcctcgcccagctctgcagggacagaaggcagacagcacagtgcacgggcaacaagggagttgggcagcaaggagcatgcacattgagtcaggcacatgcagggccggccagggctttcctgctgtctccagacccacatccccaggttgtttgtagtagaaagaaaggaagttgagattttgtttttgtttttagagtcttgctctgttgcccagctggagtgcggtggcatgatctcagctcactgcaacctctgcttcctgggctcaagcaattctcctgcctcagcctccagagtagctgggaatacaggtgtgcgccaccacgcccggctaattttttgtcttttagtagagacggggtttcaccatgttggccaggctggtcttgaactcctgacaggtgatccccctgccttggccctccaaagtgctgggattacaagcatgagtcaccacacccggccagtttttttttctccctcttgcccaactattctcatgcatccagaaactttgggaacagacagtcctatgtcacccttagtggaggatgtgtctcagatctgtgacagaaataaggaattttatgtccatatttacacatgcttttttttcagggtgttgctttcttgcccaggctggagagcggtggcatgaccatacctcattgcagcttccatctcctgggctcaagcaatcctcatgctgcagcctcctgagtagttgggaatacaggtggacgccaccatgcccagctaatttatttaatgtttattatttttattatttatttatttatttttttagatgcggggcctcactgtgttgctcaggctggtctcaaatacgtgggctcaagtgatcttcccacctgggccaatttttatacatgcgttgattaatcacttccttctccggttctgggttttcttccatgcatacaatgaatttaactatatttctgtagactcaatacattcatgcctctttacttttttacattgtgttattgcacatttaaatctctggactggtaactgaaatccctgaatacctgtaggtgattgtgggctcagcagtcagtgtgatttcaacgttggctcacagtggcttggaaagcctgtatggaaagtatttattgaggaaaagtggagagtttttagcaacaattttgaaaaacagagacaactaatgtcctccctccctcctttgcctctccttattgccaggtttcatgttttctccaattgttaaaaatcaccatataccattttgtgatgcaaacattttacttctttaatcatccccttcctttctctagacctctttttctggaagagttctctgcaagagggacaaaaggattttcagaaaaaagtattttaatataatttaggtgaaaagattcatcatgtttaagaaatagtcaagatgaaatcttgaatttgtcaaaattcaaaaaatgggtttacagaaactccatcccttttttctctatcatttatccagtgagaagcatggaaaacatcactccctggtttgtggctgcttcactgagtagtcaaactgccggacctcttccgtcaatatcatcacacatccagatgtaatagccacaagatgcaaggccagtttaaaacttcccccttttttcttctcatggaaatttccttcaaactgctagcactaaattcagcattacagagtcacaagtaccatggccaagagggatcctggctcaaatgtttgggagggggctgcagcagcggtagcccagctgaagacaaggccggaatgtgtcttcacactcccccaacctcctttttgaaacagggtttccctctgttgcccaggctggggtgcactggcgggatcataacttaagctacctcgggcttctgggctccagcaatcctcccgcctcacattcctgagtaggtgggactacaggctatgccaccatgcccagctaatttttaaaattttggcctggcctcactatgttgcccaggctggtcttgaactcctggtctcaagtgattctcatgcttcagcctcccaaaatgctgggattacaggtgtgagccattgcatgcggccttccccccgccccgctccctgctttttttcatttatctaaggcttaaggttgatctaaggctttacagaagtccaggaaactgattattttcctcccacttggaggaaagagaaattcaaacttttaacatttttggcctacacaaagctcacctttggtaacgtatgggtcctttccttacctgcctttagaagaaaagaaaagccaaagtcagcatctggctgcacttttcccccttaaattatccagcacagaactgcggacgagggatccagtgagccccctctcttgcagttggagggattattgttaaatgctgggagtacatgtgtttctaacagatagcaggtcggcagctgcttcacattatggggaaatccatagtctccaaggtgttacagcttcatcatctctaccccttcactcttcctttattggaagaaggatttcacattttatagtgagtcatggtcttgctggtgaatcacactgctgctgctattgtgtcagggatccccaagaccaccctcgctttcagtgattccctcaaattatctcccatccttctgcatagaatgctcctaactgaagccagccccctcacctcagctcaggatcccacgcctcccaccttctcaggggctctgctcctgcagtgatctacttctctctcctgaagcatcaactgctccctctatattggatcattcctcaagctaaggtggaactcaccttcttcccccgtgtcactcagtagctactaatgcatttatctgctgccattgaaggaagaactgcatcaatgtaaacaacccactacattgaagtaaattatctagaaaggaaaatgaaccaggacaaaacaattttgaagcataactttgggaaactcacactacaaaatgacaagattcatattaattttatttatttatttacttattattttattatgatgattttaatcatccagcctcatacatcaattatgttaattctatagtaatcaagacagtgtggtattgggaaaaatcccaacagattagaatagagtccagcaatagactcacagacattaaaaattgattttcagaagaggtgcaaaggcaaaggagaaagattatcttttcaagaaattgtattgttttcttcctgcttcatggccactgcatttactgtttatttattctcctgggtcccttccctgtgtttctcctttgtatttcagctgcttttctctgtaagggtctgtctgccccatcacaatatgatagccctcacagcaagtaccacgtgttattgtgattacttgatgtatcaatcccatcagtggtggactggataaagaaaatatggtacatatacaccataaaatactattcagccataaaaatgaatcagatcatattctttgcagggatatggttggaggtaaaggccattatccttagcaaactaaagcaggaacagaaaaccaaatactgcatgttctcacttaaaagtgagagccaaatgatgaaaacacatggacacatctgggggaacaacatgcattgattgggtcctagcaaagagcagggagtgagcagatggagaggatcaggaagaatagctaatggatgctggtcttaatacctgggtgatgggatgatctgtgcaggcaaccaccatggcacacatttacctatgtaacaaacctgcacctcctcctgcatttgtatgcctgaacttaaaagtaggaaatttaaaaagtgaatatctcagaatcttacaactatgtcttggtcaatgtgttatatatcgaagcattatggtgacataaaagcttgggtgtagcaacacttagtatgattggaaatttagcaggattatagcccagtaagatctaacatcaaatactaatattgaattgcactggacttctccaagtacttaaaggaaagttggtaaaaataaatattcatgcttgaaaatattttgaaatacatgtaaaatggatcaacactgaataccacagatgtcattgtcactggatgctaatgaagtacataataggaaccataagacacagtcaacaataacaggagggaaatgaaagaagcacatcaaagcaccatcagatgagtgcagaagcacacacatgaacacaccctgcagctgcagaaacacatggtaggaagtagagccccacaactcatcagccttccttctcaccaactcaggagttcacaaatttgtttactgagggtcaaatgaccacagtaaaactgaccaatataaacataactgagatatatttcaagcattatgtagaaagctacagacaacagtgaacttattctgagcaggtcttaatccatcatcttcacagaagcctaaagaactggcttctagacattttgtctgataatggctaaagtagtgaacttcaaaatgtttattgcaatgcatgagaaatacacagttacaatgcatgagaaatacaccatttgtgtatattctactaggcaaataaatatgtgcatgtgtatgttggtgtgcagtctatttaaatattctatatgcaataaatgctatttactattttattttatctcatttctttaaaatgctgtttgtggctggcaacatgtgtcttaggaaccactatggatgacaaaccagcatggaaaatatttaatccttttcacagaacatcctcaatggctaataaatgctgttatagaagtatatgcaggccgggtgcagtggctcacgcctgtaatcccagcactttgggaggccaaggcaggcagatcacgagatcaagagatcgaaaccatcctggccaaaatggtgaaaccccacctctactaagaatataaaaattagctgggcatggtgacacgtgcctgtagtcccagctactcaggaggctgaggcaggagaatcgcttgaactcgggacgtggaggttgcagtgagccgagatcccgccattgcactccagcctgggcaacagagccagattccatctcaaaaaaaaaaaaaaaagtataggcaaatacacacgggaacccaattttgccccctccttgggaattcagtcttttcagacaaaaaggtcgtcttttatgtggaccacaaaggctaccacaaaatatgtaattactgatgaaatgtgtgttccatctgcagataactgtgtctgttttgtacatgtgaagtgttacttggacagacaagaactcacagacaaaagagacagcaagtacatgtgacctcttgtcctctcggcctcatgtggaggcttcacttgggctgcagcatagctaaatgcatttattcacagggacctccatttccctactctgctccccttttatgaggcaagtaggagacttccacttaacatgataggtagtaaataatttgacctcaatcaccaagcattctgagttcaggtgacaatgttcactacaatactctgaaaattgctaactcctcagaatctgtagactttgtccacttaccatcctgttgaaatccaaatttgttcagagattcctgtgcttgaagtatgggaagctctagtcatgtgggaaattgagccctcccacaggtagaccggctgtgctggtcccagctctgactcttcccttagcagctagagttgctagggtcatgtattagacaactcttcttgtctctacagtatctttcatattttctgctgtttcctgtgtgttgcaagggctacttcacaacttgctcccatcccaatccattatgatcctttaacccatccacttggtcctgggttgtctcccacaggaatggcaggaggaagctcacatttggcatgaggttaaagcctggcctttgaagctggagtggagccattcagcaatcattaaattccaggtccttgtgaagcagaaccgtccagccatctgatgacatgaccttgaccatttgctaatgagttgctcacagaaagtctaaatccattctttgagaacctatgagtgcactatactaaaaactagagttaatacgggacaaaagaaagtaaaatttaatggtgttcttgccaaaaaagaaccaaaaagataaaagacaaattaataatagatcaggattatgactactctcactccttaaaaaaactttgaagaaccacaattcttactcaagctgctttttacagagagggagggagggactgaggaaccacacatttccttctcaaggtatttccttaaaaggagcccagctagatggaatatataggagtcaattcaacaatatatcctaatttgtttacaacaagctacattctgatcagggcccccttcttatccttctcttctatatactatttctcatataaaactgggaataatataaaagtaataagaagaggaatcatgcacacagcttactatctacataaatgagagtttatactccactggcttcatcaatgtaactttagtaatacaggaatcccttgccaaggaaaataaaagttgtaaaaaaaaaaaaaacaaaactattgttcattccagcaactgcctgaaagatccatcaactcctcagtaaaatgtgtcaaacgacatttctcaatgccaaagctctttgaaccctttgtctaaaaatcctcctcttgttgtgttcaccaatcctcaattattatgattcctaccgaattctaaccaaaccatcccccactttaaaaaatgcacttcacaccagactccaaaatcagaataaatatacctaaagcccttccacatgtgtgacatacgagtgtctctgtcgaggtagtgctctttcttacagcgttatgcaaataatgtcagtactgtcttatgaacaggttgtttggctgatatttgggagtatatgatgagcatagtcaccactgctgtgcatcatatcacagtagactgagcctagaagctacgatcaatatctatggatatttcagaaccctattgcctgaatgatctacaggaaaattcagaaaaaaacagttaccagtctagagatgtaaatgtgcaacaacacaaccttaaaaagtaaaatggtgtgaatttattgagtatacagatagtcaaactcattgtgcacatgacagaaaaccctgaaccagagaaggaagtgattaatcagggcatgtataaaaattggcggaggtgggaggatcacttgagtccatgtatttgagaccagcctgagcaacacagtgagaccttgcatctaaaaaaataaataaattagctgggcatggtggcacccacccatattcccaactactcagagggctgcagcatgaggattgcttgagcccaggagatagaggttgcagtgaggtatggtcatgccacctccctccagcctgggtgacagagcaatacactgaggaaaaagcacatatatatatatacataaaattccttatttttgtcacagatatttctgagacacatcctccactaagagtgacatgggactgtctgttcccaaagtttctggttggacaagagagagagacaaaaaaaatctcctaagtccctttctttctactacaaacagcctggggatgtgggtgtggggacagcgggaaaaccctggcctgccctgtatgtgcctgactcagcgtgcacgccccttgctgcccaagtcccttgttgcccgtgcgccttgctgtcttctgcagagctgtgcaagtagacatcatgacttccttctgtctcactgactacgactaagtcagtagatcctcagatcaatcctcccagaagttgaagtgtgagtgaatgtgaggaggagcccgtagtcatggtccaggacctcctagggagaagggctttgaggtccccgtttttctcctaacagtcagtgacgcagctatggccttgctgtggtggggggcctggacaggggaggaaggaaagtcatagagcagaggaggttctggtgaacatggagtgagttttgaagggggaaattatttgtggtggttgaatcctggaggcatatgaaaccccccacagaggatggattccaaagtcctcaatggggacctgaaagggggtgaaagagtgcaggactacagggtgccaaatggactggtgtgaggctgggcaccaggcaccaatctcactttgcatgctccttgaatgcccacctcaatgcatgttcactggacatcttccaattgatccctttgccagcgtggtgaactctgtggagctgtgagggtgtgagggttgcattcctgcattctggatcctttttccccaatttggacccagctggtagaacctcagaccagtcctcccaggagttgaagtctgaatgagtgtggggaggagccagtgagcttctggagtgttgggcagcatagtccctgaccttggagggtgaagagtcttcgtccttttcctggtgtaatagcattgccatgggccttgtgggacactcagaatgaaggaggaaggtgggccacagagtggagggggtgcaggtgaagatgaggagagtgctagggggagctattggagttttcttagtcctgaaagcacctggaaccctcaacagaagacacattccagaccccttggtggagacctgggaaacagggaggtggatggttaggaaagggcctgggaactgggaaccccgcgggctggtgaccaggcccgagatctcttgagcaccctgaagagctgtccagtgaggagtgccctgttctgtgtgccaacttcacaactccaccctggatgtccaaatgggactgtgtgttccaacaaaacttgattgtacagaggaaatgggcctagcaaatggatgtgtgacaaaagccgtggtcactgtagttttaattctctaactgtattttcctaaatgtctccacagagcagagttcagttgtgaaatcaaacctcatcggaaatatcctgtcttttgccaggagccttaagacattgctcagctagcttgaccacattaagtggctttacaaatatttgattcagaaggcacacacacttatacttgccctgggactttcaaagtgtttgcaaatttttaaaaaaattttgcaagttaacatttgtccatgaaagtggtcaaatatagctgtcctctcaagcgcattttcccaatcatagtattgtgtttgcagagtgaaatatgagttggcgaggaagatcaacatataggcctagaccaagatgatatttacaacctcttcagctgattgggcctatgcatgtgagtgacttaacattcaatgttttctattagcagaaatttctttttgtggtagtgttgttgcactattatagatgcagtgataaaagtatcccattctgataaaaaatgatcatagcatctcataaggaaacactagcccaagaatattatgttctggttttgcctggatggatgatctgtgctccccagattttgcacctgaatctctcctcatgtttattgataacagattacacaaattcatcccaacataaattaaaatggcttccgaagcccttgagtgtaactgtcttagagtaacctctctgtgggaagaataactttatgaagaataggtttatggaatagtgttgtagaaatgtctttagacttattcatgatcagggaaaactctgtattctgcatatttatattattgacatgtattaatgaaaaaaaccttttatctgcacacacacatatatacccctagcccctggagcccagtcatgaagagcctcaagaagaggaaccacaaactaaaaatcaggatcctacacctgttcatgacagagatcagggtacaactgaaattcaaggtgctgggaagggaaagaaagaatgtctatgggggaaggaggcctatgtgtgcatcatgcattatgccatgaccagtaacaggcggaaacaaaatattaggaaaggatctcaaacatttgctgacagttggctggaaaagggaagaggatattttgcagcttcatgcagtccctgaatataatgaatcttctctttttgtttgagatgtattttgtatgcttgaaaatatagtcctttctatataataaataagaaaactgaggcttagagattgaggcctatgaagaagagttgactcatggagacagaactcatattacattccaagatttgcgttgttcctaccatctatgttgttagaaaacatgaatgattttgcttaaaatgtttaatactcgaatgtgtctgtatggtaaagtacttcaatattgcctcacaagaaaacacagttcagtgaagcaggatagcaactccagaaaagagctcaatgaatggcagccactgttccctttctttggtatttctggcagtatatgtggaaaagctggataattcaggacactggcatgcagatagatatattagtgtgattttaagggacttttaaaggttgtttaaatactattataattagaaaattcagattgtgataagattatcttgagacaaattatttcctcaatgggtagcattttcaagctaaacattgacagaatttgggccatgaattattttagcaattcactcttaagaggtttccagaataagatcgtcaacaatgcccagtaatttctttgaactcaggttctcatactttcactggaagacagtggttttgctattatatttagtacttttttcttaatgggatttatatatggaaagtcacatataggacagttggacctaagcataactttaattaattttaactaaaacattttcaacaggggatgggcatcaggactatgtttgtcatagacccaccaataccttcatctaatccttcagaaaattatatttaaatcatgattaaaatgctattcatgaagcaggcttcagattcctagatagctgatactcactgttcataacattgtacttttgataattcaaagagagaacattactgctcctttaaaaacagagttcaggccaggtgtggtggctcatgcctgtaattccagcactttgggaggctgaggtgggcagatcacttgaggtcaggagtttgataccagcctggccaacatggcgaaaccccgtctatactaaaaatacaaaaattagccgggcatggtggcacacgcctgtagtcccagctacttggggggctgaggcaggagacatcagataatagcatttaaagttcaaaaaccataaggaactaattcccgagtagtagatataagtatcttttacacatattttccaaattgctgactgttaattagaagagcttctgaatgtaaaggaaggactccatgtttagggaagaaattacctaaatgcgtttactctgcactgctgaaccattccgttagacatttacattaaaagatagttttcagacgatttccaggagtctattgaacaaggctccattgtattcttaggaagatcatagccttaagtgcatatcttattaaaatagcaaattacaggataaatgaaagtgataataataaataaaaatagtaatagaagacccacagaataaacttaagggaaaaggaaagcaggagtgaataaaaggtatgaatcattaggaaaaggaaacgtaatccaaaagcaataaattgaaatgttgttctttttaaaaatagctatgaatagagtatctaatagtttacataatcctgaagaaaatggtaaaagctcaacacagaatatgaacaagaccctaacagaactcaatatacggtataattgaaagtgaatatattcttgaactctagtattttcaaaatatggacgaaatggttgataaactaggaatgcatacattagtaaatatatctcaggaatacctgaatatctaaacatcacaaacactgtggaggaacttctgaaattttccagttgacactcagaaacacttacttctagaaacaaatatttgccttttaaagatgtcttactctccttttccattttcctctccctccatttctttttttttttgccccattgttcatgatatatgcctctatctaaaatgatagtgatagattaaaacgaatgtgaccatgtaatttattttacaaaagggaatactttcaggtgtaaaaagaggcactcttcatattgacatcataatgataggtgaaaaccttggacaaatagttactgtaccttgaaatccacagaagtgtaaactagctaaagctacatttttgcacttttgtgccacagagacaaacaaatacagtatgggcttttccattcaatgtacttatgcagttcctgatgtgacattaactgtttcccaggagcttgtcaaacatccagtctattatttcaagccaaaacactaaattatacaattttgtaaattcctttttttcttagatgttttgtgtatcagtgatatttttagtaaatgtatacacaatgtttgctttccactttgagccactttttattaggttcacttgatttaatgtgttctgaccttagactgtcttttggttttcttgtagagcacagaaagcagggtgggttcaaaaaaagttaatactgtatatgcatggaagtctatcttcaaagtccctacaggggtcttattgaatgttagccatagggtgacacttaggcttacagttttagtcttttgcataaaaccaaaactttgcatacctttaatgtcatctaaatacagttctgctagtaatattccctcctgttatgtttctgttacacgtgaagggcaaccacagttttaaatgaagagaagctgaaagaatgcaaacggtttttatatttgatatttgacttaaaaatatctcaataaagttttacagttttattcaaagaagacttgcacatcttttgttaattttatttcacatattttatactactgaaaagtgtggccaggtgcagtggcttacacctgtaatctgaggactttgggatgctgaggcaggaggattgcttgagctcaggagactgacaccagattgggcaaaatagtgagaccctgttctctacaaaagtaaatgattgactgaatgtatgtatttatgtagctgtagttcaagctactccagatgctgaggtgggaggatcacttgagcccaggaggtagaggatgcagtgcatgttcatgccactgcaactccagcctgagtgacagagggagattttttcaagagtaaaggtatcatttctttaaattttgtatttcaaagttttgaaattttgaaaattgagttggtatacaagtgttggtatggtttggctgggtgtcaccacccaaatctcatgtttaattgttcccagtgtttggagagggacctggtgggaggtgattggatcatgggagtggatttcctccttgttgttctcctgacagtcagttagtactcaagggttggggctgaaagttccaaccctctaatggtttaaaagtgtgtggcacttctcgcttcatgctttctcctgcctccatttgaagaggtgcttgctttcccttcctccatgattgtaagcttcctgaggccttccaattatgcttgctgtcaagcctgtggaactgtgagtcaattaaaccttcatcagttccccagactcaggtagttctttatagcagtgtgaaaatggtctaatacaggtgtgattttgtgaaatgtgtatttggtccttgaccctgcttactggcatacagtttttaaaatgtttagaatctccaaaaaatgatatcttattgtatgctaattagttggctgatggctggcagcccctaagtagctctaggatgggggattagagggttgggactttcagccccacccctaaccttcagggaaatgagagggactcaaggttaacttggtcaaaaatggctagccattggtttcatcaatcatagctacataatgaaaacctccaaaaaacccaaaatgacagggttcagagagcttctggctagctgaacacaaagagggcagcatgcctgtagagggcatggaagctccttgcccctttccccattccttactctatgcatctctttatctgcatcctttctaatatcctgttttaataaacccataaacgtatgtgtttccctgagtcttgtgagatgctgtaggaaattaactgactgaacctgagtaggactcatggaaaactcaatttatagctggtgggtcagaaacacaggtgaaacaacctagggcttgtagtgagggaaatcttatgggactgagcccttaacctgtgcaatcttactctatgtcaaggtagcttgtgtcagaattgaatgagaggacacccagctggtgtgtgctgcaaaactcattgcttgtttggtgtgtgtagaaaagcccccacacatttgatcacaaaactcttccatgttaattgttgtgaggtaagaacagagaaaaaacttttttaatccattcaatggattcagtgtttgtttattggttttctatccagtaaccttgctaaatatacttattccaaatttatctctagatcctttctgaatttcaacttacacaatcatatcatctttgaataacaacagcttgtttctgacatttcaaacagtacgctttgtcctttttcctattttacaacattggacagacccacccaatagaatgctgaatagaaccagtaattgtggccatccttctcttatgcctaataggcactggaaagttttttttaacattttacaatgtttcctgtgttttttaatatagatacactttatcacaatagagagttccattgtattcctcatttcctaggagtatttatcttcaatagatgttgaatttcatcaagcacttgtagtgcatccacacagatgatcataggactttttcttttattaatctgttaacgtggtgaatttcattggtaagttgctatgtttaaacaaaccttgcctttctaggggaaaaaaatgggtcacaacatattatccttttttaataatctatgccttactaatttgtttaggatttttatgtatgtcctcataagtggcattagcctatatttttatttcatgtacagatgctccttaacttaccatgacattatgtcccaataaatccatcataaattgaaaattgtgtaagttgaagatgcattcagtacactaacttagcaaacattatagcttagcttagcctaccttaaaagtgcccattaccctacagttacagttacgttgacattaccctacagttgtgcattaccctacagttatattaccatacagttacagttacacttacattactctacagttgtgcaaaatcatctaacacaaagcctattttatcataacattgaatgtctcatgtaatttattgaatattttcctggagatgaaaaacacagtggttatatggctactcaaaaaactgtttccactgaacgcatttcattttcacactatcatgaagtcaagaaattttaaatggcggcatcaggagtcaggggccatctgtattctctttgttggactttggtatcaaggttacactggcttcatgaaatgaattgggatataaaacctctttctattctcaggaactgaaatgtctgcaagagtgaatcacttacagataggatttcccatgtgtgtttgtttgagattgcatatcttttttaactttggacactacttaaaagaaagacagaaggggcagctccagatttccatgcctttaaactttgtaaggcacctctcttccccacaaagatgcctctaatgatgatgtcactctgaaaacaatctgctcctgtttctgtactgacattatcctctgtacacagaaagttaaaaattgccactctattaatttgcttacataagttttttcagagatgtgttcttgctaagttgcccaggctgatcttgaactcttgagctcaagtgattctccctcctcagcctccaaaagtgcttggattacaggtgactgccaccgtggctggtctgtctacctgatgttgatctgtggtatgtgattgtgaatggattggctaaaccaaagctgtgaatagttaggacaatagctccatttatttagttctttaagaagaataggaataataactcacatttatagagtgttcagtatctgttagccagttttctgagctatgtttcattgtttctgacctcatttaatcctttaaaaaggggagtcagagttttcataaaatttacaacaaatgactctagtaagaagcaaatatgaggattcaagttctaagttcacagtctgtgttttctcaaagtaaatacttctgaaagtgttgaatacagaactagtgttgtatatgttgattttattggtaattgcatattttcatacacatctatggtaatatataaaatatatatatttttcatttttcaacataaaagattttggtcttatcttgaagaaggtgtttcccaaaatatggcacatagagctaacagacattaccagatgaaaccattggtacaaaaacatttttaaaaattaataataacatgcctattttactctgctacagaaaaatagaacactaaagccatttggaatagtttgtgggaacacagagagaagggatttctcagtccccatggaaaaatgccacaataacttctgcaaacgcttctgacctttctttaaaagttattaagaggcagggagggagaagcaccaagcctctttttccatctgcataaaactccatcaccctgacagtcaccacatctcattcagaagcccctggagctgcctggatccagcctgatatcccttttactgtaaataatacaccaattgcaactctgagctccatgtgtatcctcacacccaaaaagatatttttccaacaaaggtccctactcagaatccacagtgtttagggagtagcaggggattataatcagcaattatttctccctcttacagagattttaatgtatattctgatccaaaatgactgaaaagatagagttgaaaaaaaaagtgagactaagtgtaggggatcccatttgacataaaatatgtgagaagtcccaaggctgtaaggttggttgaaagaattagggtgtaggtagaagaaaggggagagcaaccaggggagcttgctaaggcaaaatgacttgggtcctagctaccctgtctccttatagggtatagcatgaaattggcatgggtttccatcgtggctctaacactcgggcttcaagatggtgggcaaggcacttataccctgtgggactatttccacatttctaaagtagaaattagaatatttacagtaaatgattgctatggagaataaatgaaataatatactaagtaggcattacattgcagataatgttgtttactagttatatatttttcttttacaatttattttttcatttgacttgtctttacagctacatctatagtaagtgataactgctttggaattgtaagaaaataccaaattgcattttaaaatgcatttgacctcccaagattatttgatttacataaatatgttcattaatgctgtcattagtatgtgctagtcagtagtatgtgctgcaaactgttctcctggatcagtgtgatttcacaaggaataagtcaatattctggtcaggcaacacaacacacacctcaatacaatagtgtgtaaagtgctcaagaaatccctaagcagccctgcggtggctaaaagggccacaggtatcaccattgcagttcttagtttgatttgtcatatatccatagatttggccagtaagaacaaaatgagcccaagtggatccaagtgattgattgcttgaaggcacagccaaagcaagatcagcattgtgtcagcactgtgtccctagtctcacagtatgacactgaattggaggtacaaaataacagcacaggtggtgggtctccttgcctgcgaggagcccacaaccataccctaaagccaatgctggaaccacactgaatactgagatcacgatcacacctgacagctgtgactatgggacagcaggggtgacccagctcctgaacattccatgtagaacacttagggatgtcatccaggcttgtgaagaggaggaacaagtgtcaatgaccaccctgaactgactgccttctgagagtcccactaaaaccaaagatgcaaatgaattatttggaccggacgaggaacccctagagggaaaggtcacacagtgggaggccacagtgggggccttggccagctcctgcctgacaactgtatgtcctgctggggggtgccctatcaagggtaaactcttggagtccaggggtatcacctatgccctctgagatttttcttacatgtgcgccctgactatcccttcactgcctcatccctggaaggcattcacatcagcttcagcttcctggccagagttgtgctgagcctgaaatggtggcttggcctggccaaaaaaaaagtttaatacagaatcttaggtaggaagtaatctgccttcctaaggtagacatccatcattaataggatttgtataagatggctgtgatgggaagtttgatatgtcaactttgctaggccacgatacacacaaaaaatgttcaccttgagcagagtagatgtctctgtgaaaggtattttttacatgagaactaacatttaaatcagcagactttgggtaagcttaattgccctccacaatgtggagtggccttcgtccaatcacttgaaggccttcagagaaaaagactggggtcctcctcaagatcaagaatttcaggctccatgctgcccttagatttgaggtatcatatcacctctgccttgggtctccagcctgacatcctgctctgcaaggtttgggtatgccagcacacagagttccatgagccagttcctcaaaatcaatcaatcaatcaatcaatctctctctttcttcccatgcacacacccacagaagaagcctaatcaataggctgcttacatctgggatccataaagggtgtaaccaagatcagtaatgcaggtaggtgtcactctcctacatggctcctaagacagaggtctctcccaccctctgcagactgacatccatgtggctcatcactgtgacactgggtttggtcatccaaccatgtagagatcactacaattccacaagtgttccctgccttctgcctgtcacattctatgctccatcctgaggacactgggatctactgtgtatgtttccaaccttccaggaaagacctgggagcctagtgagggagatacacctgcaaagagaacttcagtgcagtaatagcaatgggcatagccgatgttgttcaccaactcatgagacttcatactgtgaacatctcccacttaagtttccccatcaactaacaacttatcctggaaaagaccccattggtcagtaaattgaattcccctcactatttgccccagggatgcacagctacaaagcaaactgatactggtatattgtgacagagtggaatccaagaaaaaaatgccctgcagtgatgtgatttccacagcagtaaataagtctttatatgttcccagatgaagcaatatgcaagcctccctcagtttacaaggaagtgacatgtatggaaaatctagtttatgtaaaattctggaacaagacgtttgcctcacttaacactcagtccccaaatgccagtagctcctgccaattattccaacaacagcagcagcccacagatatttccaaaatgcctcaaagtgggcgatgatattctggctataaatcacaagtttaggattgaaaataagtatcctcaaacttcttatttacatcaaaagaataggaatgttgtggttggcacagaggaaataacacggcaccaggaaggagaacacaatgctccccaggaagggctgcaggaaccttcctcctatgtcttgttttctgtgataagaatgtgattccagaataggtgtggtggctcacatcagcctgggaacatagggagaccccgtctctacaaaaaattttataaaacatagccagggttggtggaacatgcctgtagtcctatgtactagggaggctgagatggaagcattgcttgagcttgaaagtgagccatgatttgtccactgcactccaagctgagcgacagaaagagatcctgtctcaattaaaacaacaaagaaagagagattgcagcactgactcggatggacagagcagtgtgtggaggctcacatcatgaatttttgctccagaacaactgcaggaataaattgggaaatctgagaggacccacagaccctctgaaggaagcggattgctcctgtaggacctgggagacatcccaaatactgtgagtgcccaaactgtggaagtgggaaagggagatcacccaaccctgagcacacactcccactggggaaactgaaggtctagattactgaagaagattctggccttacctggagctgagtcagtttagagagctaagcaaaatacaggagtagaggaagcagcagaaaaagccctgtgagtgtgctgtgttccctagcaagtcgtctctgcttggcctcacaagagtccttcaggagggcagccagaggcactgggaaaaggccacagaaagaaggaaatctccagctgaacttagtaacaatttgaactgatccaagtgtcctggccagaacttgggggagggtgtgaatccggtgtgcagattccataggcaggggaagaaggaaagccaacttactttcacagctaggaggcaggtagcctgggacaagttctcagccctgctcacccactgcctggaaacagacttggtgctgttgggtgggggacggtgggagtgagaccagcccttcagattgtgtgggaactgggtgaggcctgtgactgcaagctttccctgactcctctaacaacctgcgtgacacagtagagacagccataatcctcctaggaacatcacatcacaggatggttcacatcacaggactctgtgcagacaacccccagtaccagcgtagagcctggtagacttgctgggtgtcttgatccagaagagagataacaatcactacagatcagctctcaggaagccacatccataggaaggtgagagagtactacatcaagggaataccccgtggtacaaaagaatctgaacaacagccttcagtcctagaccctccctctgacagagccagcctaaatgagaaggaagcagaaaaccagctctggaaatatgacaaaacaaggctctttaacacaccccagaaatcaacctagctcaccagcaatggatccaaaccaagaagaaacccctgatttacctgaaaaagcattcaagaggctagttattaagctaatgaggcaggcaccagagaaaggcaaagcccaatgtaaggaaatccaaaaagtgatacaagaagtgaagggagaaatattcaatgaaatagatagcataaataaaaaacaatcaaaacttcaggaaacaatggacacacagaaatacaaaatgctttggaaagtctcagcagtagaattgaacaagtagaagaaagaaattcagagctcaaagacaaggtctttgaattaacccaatccaacaaagacaaagaaaaaagaataagaaaatatgaacaaagcctccaagaagtctgggattatgttaaatgaccaaacctaagaatagttggtgttcctgaggaagaagagaaatctaaaagtttggaaaacatatttgggggaaccatcgaggaaaagttccccagccttgctagagaactagacatccaaatacaagaagcacaaagaacacctgggaaatccatcacaaaaagatcaccgccaaggcatattgtcatcaggttatctaaagttaagacaaaggaaagaatcttaagagctgtgagaaaaaagtgccaagtaacctataaaggaaaacctatcagattaacaacagatttctcagcagaaagcctacaagctagaagagatcagggctctatcttcagcctcctcaaacaaaacaattatcagccaagaattttgtatccagagaaactaagcttcatatatgaaggaaaaatacagtctttttcagacaaacaaatgctgagataattcagcacgatcaagccaccactacaagaactactaaaaggaactctaaatcttgaaacaaatcctggaaacacatcagaacagaacctcttaaagcattaatctcacaggacttataaaacaaaaatacaatctaaaaaacaaaaacacaaaacaaaaaatcaaggtatacaggcaacgaatagcacaatgaatggaatgacacctcacatctcaatactaacgttgaatgtaaatggcccaaatactccacataaaagatacagaattgcacaatggataagaactcaccaaccaactatctgctgccttcaagagactcacctaatatagaaggactcgcacaaatttgaggtaaaggggtggaaaaagacatttcacacaaatggacaccaaaagtgagcaggggtagctattcttatatcagacaaaacaaactttaaagcaacagaagtttaaaaagacaaagagggacattatataatgataaaagaccttgtccaacaggaaaatatcacaatcataaacatgtatgcacctaacgctggagctcccaaatttataaaacaattagcaatagacctaagaaatgagatagacagcaacacagtaatggtgggggacttcaacactccactaacagcactagacaggtcattaagacagaaagtcaacaaagaaacaatggatttaagttataccctggaacaaatgttcttaaccaatacatacagaacattccatccaataactgcagaatacacattctattcaacagcacatggaacttgctccaagatagaccataggataggccacaaaatgagcctcaataaatttaaggaaattgaaattttatcaagcactgtctcaggccacagtggaataaaactgaaaatcaactccaaaaggaaccttcaaaatcatgcaaatacatggaaattaaataacttgctatgaatgatcattgggtcaaaaatgaaatcaagatggaaatttaaaaattcttcaaactgaacaacaataaagacacaacctatcaaaacccctgggatacagcaaaggcagtgctaagaggaaagttcgtagcctaaacacctccatccaagagtctgaaagagcacagacaatctaaggtcacacctcaaggaactagagaaacaagaacaaaccaaacccacacccaggagaagaaaggaaataaccaagatcagagcagaactaaatgaaattgaaacaaaaaaatacaaaagataaatgaaaaaaaatccggttctttgaaaagataaaattgatagaccattagcaagcttaaccaagaaaagaagagagaaaatcctaataagctcaataagaaatgaaactggagatattacaactgacatcacagaaatacaaaagatcatttaaggctattatgaacacctttacatgcataaactataaaaccttgaagagatggataagttcctggaaagatacaaccctactcacttaaatcaggaagaattagataccgtgaacagaccaataagaagcatcgagattgaaatggtaattaaaatattaccaacaacaaaagaaaaatccaggaccagaaggattcacagcagacttctaccagacattcaacgaattggtgccaatcctgctgacactattccacaagataaagagggaatcctccctaaatcattctatgaaaccagtatcatcctaataccaaaaccagaaagggacataaccaaaaaagaaaactgcagaccaatacccttatgaacatagatgctaggagaaatacctaatgtaaatgacgagttaatgggtgcagcaaaccaacatggcacatgtatacctatgtaacaaacctgcatgttgtgcacatgtaccctagaacttaaagtttaataataaaaaaatactagctaaccaaatccaacaacataccaaaaagatattccaccatgatcaagtgggtttcatagcagggatgcagggatggtttaacatatgcaagtcaataaatgtgatacaccacataaacagaataaaaaataaatatcacatgatcatctcaatagatgcagaaaaagcattgacaaaatcgagcatccctttatgattataactctcagaaaaatcggcatacaaaggacatactttaatgtaataaaagccattcatgaaaaacccacagccaacataatactgaatgggagaaagttgaaagcattccctctgagaactggaacaagacaaagatgcccactctcaccactcctcttcaacatagtactggaagtcctagccagagcaatgagagaagagaaagaaattaagggcatcaaaattggtaaagaggaagtcaaactgtcactgtatgctgttgatacgattgtttacatagaatacctaaagatttctccagaaagctcctagaactgataaaagaattcagcccaatttctggatacaaaattaatctacacaaatcatagctcttttatacaccaacagtgaccaagctgagaatcaaattaagaactcaaccccttttacaatagctgcaaaaaaataaaatacttaggaatatacctaaccaagaaggtaaaagacctctacaaggaaaactacaaaacactgttgaaagaaatcaaggatgacgaacaaatggaaacacatcccatgatcatagatgggtagaatccatattgtgaaaatgaccatactgccaaaagcaatctacaaattcaacgcaatttccatcaaaataccaccatcatgcttcacagaattagaaaaaaattctaaaattcatatggaaccaaaaaaggagcccatgtagccaaagcaagaacaagcaaaaagaacaaatctggaggcatcacatatctgatttcaaactatactataaggccatagtcaccaaaacagcataatactggtgtaaaaataggcacatagaccaatggaacagaatacaaaacccagaaataaacccaaatacttacagccaactgctcttcaacaaagcaaacaaaacataaagtggggaaagacacccttttcaacaaatggtgctgggataattggctagccacatgtaggagaatgaaactatatcctcatctctcaccttgtacaaaaatcagctgaagatggcttaaggacttaaatctaagacctgaaactataaacattttagaagataacattaaaaaaccctcctagacattggctaagggaaggatttcatgaccaagaacccaaaagcaaatgcaataaaaacaaagataaatagctgggacttaattaaactaaagagcttttgcatggcaaaaggaacagttggcagattaaacagacaacctatagagtgggagaaaatcttcatgatctatacatctgacaaaggactaatatccagaatctacaacaatctcaaacaaatcagcaagaaaaaatcgaacaatcccatcaaaaagtgggctaaggacatgaatagacaattctcaaaagaagatatacaaatggtcaacaaacatatgaaaaaatgatcattgttcgattcccacctatgagtgagaacatgcggtgtttggttttttgtccttgctatagcttgctgagaatgatggtttccagcttcacacaccggggcctgttgtggggtggggggaggggtgaggggtgagggatagcattaggaggtatacctaatgttaaatgacgagttaatgggtgcagcacactaacatggcacatgtatacatatgtaactaacctgcacgttgtgcacatgtaccctaaaacttaaagtataattaaaaaaaagaaaaaatgatcaacatcactaatgatcagggaaatgcaaatcaaaaccacaatatgataccaccttactcctgcaagaatggccataatttaaaaataaaaaaatagtagatgttggcatggatgcagtgaacagggaacacttctacactcctggtaggaatgtaaactaatacaaccactatagaaaacagtgtgcagattgcttaaaaaactaaaagtagaactaccatttgattcagcaatcccactactgggtatctacccagaggaaaagaagtcgttatatgaaaaagatacttgcacactcctgtttgtagcagcacgattcgcagttgcaaaaaaatgtggaaccaacccaaatgcccatcaatcgatgaataaagaaatatatatatgatggaatactactcagtcataaaaaggaatgaattaatggaattcataatgacctggatgaggttggagactattattctaagtgaagtaactcaggaatggaaaaataaatatcatatgttctcactcatgagtggaagctaagctatgaggatgcaaatgcataagaatgatagaatggactttgtggactcagggggaaaggatgggaaggaggtgaaggataaaagactacaaattgggtgcagtgtataatgcttgggtcatgggtgcaccaaaatctcacaaataaccacgaaagaacttactcatgtgaacaaacaccaccagtttcccaatattttttcattaaaaataaataaataaataaataacaaagtctttcaacctaaaaacaaagtgtttcagtgccagctggggtgtgtggtgaagcttcatttcaaagatcaaccactgccataggacattgacgctcagtatggttctgtggtagtcatggctctgggatcctgggactggtgtttttctcctcagcaaagacagccttctccaggctgggacacaggaggtaggggccaggctaggtcatcaggctactagggacagctgtttgctgtgggatcacagatgagatcaggagaaggatagctgaaaggagaagggagatgatctcctcaggtgaggtgcaggtaggtgtctgctagtgaagagaagacattggccctaagtcctggcattgctccagattcctgtggaaggacatgacagtgcaagaaagaaatcaaggctggtgggagggagatggtagattacatgacctcccatcctatgtgttcaatggttgctgataggagcccataccctttgggtatctaaaaggtcatttcttgacacccttccattcactgtgcatgacaagaagaggcctttgggaagaaagaccagtaggagttataaggtcttctcaaaagatgcactaccttacccttatggtgactcttacactgtgtccatcatgtcttgtgttcctgtgtgctctcaggtcggtcttctcaacctcacgtcagtcttgggaagagtgggtatattggaggcagtcatgaaaccaaagggatttaataaggtttctgaatgtttcctaggctgggcagtaaattcccagatcctaaggcaccactgtggccacactacatgagattcaccgggtgtgaatagtggaatctgcatttttaaaagatcctgggttaaaattttcatggaaatttgtctgagaactactggagcaggggaatagtctcctttccaagctacacagcttctttctcctttgtgaaggtatagaagggacaggtttggtgtgttctctgatggacgaacccacggccttcaggtgaggagactaaaactgacatgctgcctgttattctaatgatgctctcagggcctgtctccaaatcatacccagaccaatcctttcaagtctccatctcttaaatatttctgaagaaatcaaatgtctctagcctgtgcaatctcatactgtaaaattctaaatattttgcaatagcctttggatcttactcttggttacataaatatgcaacacagtagagtttttcatgacgcctctgacctgtggctccaccactcattgctgggtgacactgagaaacatccttaacatctctgtgactcctttctccattagtaccatggaaatactactagtaaagtcatctacttcttgggcagtttagaacactgactgttaagacatgtacagttgtcaggacagcgcctgccatatgataaatttccaatcaattctagctgttattgttttgctgtttatatcgttgttgttcccacatttccctggagcatgttccagagagacaacgtcaagagtacatttgaccctttggatgatcttttgattatcactttagcccttcagggactcaagaactgaagctaggtagcttgggggacagcttatttttataagcgtaatgaatattcagctctcctcacagggttattgtgaagcctaaatgcaatgctggggtttcatcatcatgaacttgtgtggaaaatttgaatggaaatttctctaggaaattagaactctaatgacctcttcatgcgatttgtatagcgcttggaaaagtaactagtgactggataaggatagtacataagtatataaatactaaaaagatcatgatttttctatttcatagtttgtgcatttcatatcctacctatcttagttttacatgatgctacagattctcctacgttttcgtctagcagtttgataacgttggcttttacatttagttctatgatgcattttaaggcaacttttgtatatgatgtgagacaaaggttgaggttcatttgtttgcatgtcaatttccaattgttccagcaccattccctgaataaatcattttttcccactgaattatcttggcaccctatagaaaaatcaatttaatctgaatatataggtctagatttggacccttatttcttttcttatgccattatcatgctgtcctgattaccatagttgtgaaaacgtcttgaaacaggtaatgagtcctccaatattctttgttctttataaaattgttagactattctagtccccttgcttttccacgtaaattttgaagtcagcttgccaatttcttaaaacaaaaggctgcatggaatttggttgggtttacactgaatgtatagattatttgagagaaactgacatttcacaatcttgcaatccattaacgtagcataccgctccatttgtttcagcctgctttaatatttctctgcagtgaggttgcagtgagccaagattgcgccactgcactccagcctgggtgacagagcgagactctgtctctctctctacatatatatatatatatatatatatatacacacacacatatttctccacagtgatttttaagcttctgagtactggtcttgcacatattttgttaaattttaccactaaatatttcttggggttttttgctgctatattaagtaatactgattttcaatttccaattgtttgttgctggtatataaaaatagcattgacttttgcatacttatcttgtgccatattactttgctaaactcatatatatatatatatatatatatatatatatatatatatatatatattcaagtcatggagtaaatcccatttggctacgatgttgtgtagaagtggcgttattagtattatttccctctgtgacactgccctagtgtcatcttgcaaatgttgatatattgttgatacaagagtggggcagggaagtgctgggaggagtagaggagggtccctggtgaaggctccatcctcgggcctgtgcccatggacctaggtgaggacaggcatttctattttcatgtcaaaacgttgcattttccaagaccaccctggcccaccatgctcccatcctgtgcctataaaagccccgagatcctaccaggcagagacacaggtggctggacatcgagaggaacacaccggcagaacacaccggcagaagaacacaacagcagacagcagcaaatgctggtaggccattgaatggctgagtgatgtggttgccgacaggaatttggccacagtggtcaaaggagagttcggccactgatcggcctgactccaggggaagaccaccttcccactccctccaccttctagctccccatcaatctgagagctacttccaccattcaataaaaccttgcactgattttccaagcccacgtgtgatgcgatttttccagttcactaaggcaagttccccaggatacagaaagccccctgttttatatatatatatatatatatatatatatatatatatatatatatatatatatatcctgatttttctctacattctttgtaccgattgctgggatgaatgttgaagtcttctactataaatgcacatgtgtctatttatttcttctttctgatgtatcagtttttccctcatgtattttgatggtgcatacatactcatggtgtttctgtcttctgaatcaatgcacctctctatgattattatgtaatgttccactttgtccattgtaataatctccactataaagtgtgttttgtgaggtattaattgagcacctccagtttctacgtgattcatatttgcagggtatatcttttaactgtttactttgaacttacttttaacatcctttacttttaacttctttatttttaaactgtggttctttttaacagcatataatttgttcttgctctttttatccattcttacaatctctaacgttttacatttgagacagggtctcgctctgtcacccaagctggagtacagtcatgtgatcgtagctcactgcagcctcaacctcctgggctcaagctatcttcccacctcagctcccccaggagctggaactacaggtgtgcaccaccatgcctgcctcatttttaatatttgtagagacagggtctgactatgttgccctggctggtatggccttggcctctcgaagtgctgggattagaggcatgagccactgggcccggccaaactctgacttttaatagacaagtgtaagcaaattaaatttaatgtggaaccagtttacctttaaattaccaacttgctttatatttttatttatcatatctgttttttattcaggtttttctgtttcctcccttctcttagacgagttgaacattttatactacaccatgttaatctccactattggcttattagttacatatctttgttttctagggattgctctatggattactacatgcatctttaagtaacagtaagccttcaaataatattactccactacatgtacaggatgtagtggcgtaatatttgtttacatttgtttttcttccctgtgcttttgggatcatatccaaaaaatcgctgcccagaccaatgtcatggagttgtcttcttgtgttttcttctagtagtttcatagattcgggtcttacattataagattttaattcatcttaagtttacctttacatatggtaagagatgatggtagaatttcattcttctgtatgtggatatacagttttcctgataccacttattgaaggctgctcttctctcactctgtgtttttgataactttgtcaaaaatcaattggctgtaagtgcatggatttttttctgggcttgatgagtcttcattactattttatttattgatgctgaacataatgacaaataaattcactataataaatctaacaaatctgactttcgtagttaaactccactcaaaaacacaaacgtgagttttgtatgtttgactagtacttccattcctggtgaggttcaacaagagatgaactttctgagcttcagtaactacttcctaccttgcaagataattgcaagaatgaaataaatgacagtgacaatagtagtaaagatctcacaggatataagtaccttgtctaccatctcaaggcctgtatgtcagagccatgatggaaacccatggttattttgtgccataaggggacaatgtagctaggacccaaataattttgcttcagcaagttgtggtggttgctttcccctttcttctacctagggcctaattcttcatctggctctgtagcctagggacttctcacatattccatggcaaatgggatcccctacatttagtctcactttttatttgaaccctagcttttcagtccttttggatccaaaaatgttttaaaatctttgtaacagggagaaataattgctgtgtatattcttctgcccctccctaagcagcgtggattctgagtagggcccattgttggagaattatccttttgggtgtgaggatataaatggagctcagggttgttagtcgtgtattatgtacaagaagaggcatattaggctggatccaggcagctgcaggggcttctgattgagatgtggtgactgtcaggctcagaagaaaaagaaaggtttggtgtttctccctctctgccttgtatcatttaaagaaaggacatgtttgcaggagatgttgtggcatttttccatggggattgagacatcagttcttttctccatcccacaaactatttcaaaagaatttagtattcttattatattttttctgttgcacagtaaaacaggtatgttattattaatttttaaaatgctttcataacaatgatttcatctgggaacccgtgttaggtttatgttccacattttgacaaatacttcgagagaacaacaaatccttttatgttaaacaataaaatatatgtattttatatattaccatggatttacatgaaaacatcagattaccactaaagtcaatatacacaacaccagttctgcattcaacactttcagaagcatttactttcaggaagcacaaagactgtgaacttagaccttgaatccccatatctgcttcttactagagtcatttattgtaaattttatgaaaactctggctcacctttttagtggatttaataatgaggtcagaaataatgaaacacagctcagataaccggttaacagatactagacaatctataaatatgagttattatttccattaaagaactcaataaatgcagttatcatcctaactattcacagctttggtgtagtcaatccattcaaaaacatacaccacagatcaaaatcaggtaggcaggccaggcaaggtggctgtcacctgtaatcccagcacttttggaggatgaggagggagaattgcttgagtccaagagttcaagatcagcctgggcaacttagcaagaatgtatctccgaaaaaacttacgtaagcaaattaatagagtggcaacttttaactggctgtatacagaggttaatgtcagtacagaaacaggagcaggtagttttcagagtgacggcataattagaggcatctttgtagggaagagaggcaccttacaaagtttaaaggcatggaaacctggagctgccccttctatctttcttttaagtagtgtccaaagctgaaacaaaacaaaacaaaacaaaacaaaaagacctgcaatctggaaacaaacacacatgggaaaccctatctccaagtgattcattcttgcagggatttcagttccagagcatagaaagaggttttatatcccaattcatttcatgaagctagtgtaaccttgataccaaagtccaacaaagagaatacagatggcgcccacttatgattctgcttcttggttatactcagaagaaaatgctttaatatttgatgattcaatatagctttgacccaatttgtgtctccatctggtggtgtttaaatcttgcagttaggcatctgtggtctgaactaactttcaaagtaagtctgcatttgaactctgctttctgtttttaaaggggcagtaatgttctctctttgtattatcaaaattataatattgtggaaaacagaaagcacataattttgcatcttaatggacagcataccgccttctggcattttaaattgatctgattttggcagaatcttcccctggacatcggactatctccccattcatcccccgtctttgactgagacagctccttgagatcagcttccaggtcaggcactaagaaatattaaagggtatcaattgaagcaggcaaacaagaatgataaataaggaaattataatattgtttttctcagtgttaggaaataaaatcctgtaggctattgtggtaataaatgtgatgcaaagatctcatgtctttgttttcctatattatgaaatcttattttaaatgacaatctgagggtaaatcacactacacctccatttcctatactttaccattgtgtattataaacagtgagtatcagatatctaggaaatctgaagcctgctgcatggatagcattttaatcataaattaaatgtaactttctgaaggattagatcaatgtagtggcaggtttatgacaaatcttatagccctgacatccatcccctgtttaggtaacttgaaaattttggggtaaaaattagtgaaagttatgcttaggtccaaaggccccatatataactttttttcccactttttttttattattattatactttaagttttagggtacatgtgcacaatgtgcaggtttgttacatatgtatacatgtgccatgctggtgtgctgtacccactaactcgtcatctagcattaggtatatctcccaatgctatccctcccccctcctccccacccaacaacagtccccagagtgtgatgttccccttcctgtgtccatgtgttctcattgttcaattcccacctatgagtgagaatatgcggtgtttggttttttatccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcgtttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcgcatttgtcaattttggcttttgttgccattgcttttggtgttttagacatgaagcccttgcccatgcctatgtcctgaatggtaatgcctaggttttcttctagggtttttatggttttaggtctaacatttaagtctttaatccatcttgaattgatttttgtgtaaggtgtaaggaagggatccaaaagtaccaaatataacatcaaaatcactgtcttcagtgagagtatgggaacctgagggcaaacaaattaatgggcattgttgacagtcatattctggaaaccttttaacagtgaattgctaaaataatccatggcccaaatttggtcagtatttagcttgaaaatgctaccctttgaggaaataatttctgtttcatgacaatcttattatactttaaactgtctaattataaaagtattgaagcaacttttaaaagtcccttaaaaaccatactaatatagccaatatagtaatatacctgtatgccagtatcctgaattatccagcttttcccaaacatactgtaaaaaatattgatcgaagggaacagtggctgtttcctttggtcagtattcttttgattgagctcgtttctggagttgctatcctgtatcactgaactgtgccttttcctgagccaatactgaagtaccttacaggagaagcacattcgagtattaagcattttaagcaaaatcagtcatgttttctaataacatagacagtaggacaaatacaaactttgaaatgtaatttgaattctttgtccgtgagtcaagggttcttggtaagcctcaatctctaagcctcagttttcttatttataaagtggggctaacatccctatgcaaatgggctttattcatggtgttacagggtagggttacttggcactctacatgctattaaagggtgcttacaacaccattgacaccatggctgagataatcatacaacaacattctaagaacatcaaattaaactagtgaaataatgtacatttgtatatataaaattaaatggtttcatctgatttagcaaggactgtatttttaagcatgcaaaataaacctcaaaaaaagagagaagattcgttgcatccagggacttcatgaagctgcaaactacactcttcacttttccagccacatttcagcaagtgtttgagaaccttttctaatgttttctttcttctgttactgtttatggcataatgcatgatgcacatataggcctcctctgcccccaccgccaccatagacattctttctttcccttcccagcacctttaatctcagcagcaccctgatcttcttctctctcctgaccatgtgtaggatcttgactttcagtgggtggtttctcttcttgaggttcttcatcactgggctgctgggacgaggggtgtgtgtttatgcagattagaaagttctgttatcaatatatgtcaataatataaatgtacagaatacatatttttcatcataagtctaaagacatttctccaacactattccatatccttattcttcataaagttactcttcccacagggaggtcatactctaagacagttaccttcaagggctttggaagccattttaatttatgttgggaggaatgtgtgtaatctgttatgaataaacatggggaggaaatcatgggtgaaatctggggaacacaagatcattcatccacacaaaaccagaatgtaatcctcttgggcttgcctttccttcatgagatgccatgatcatttttcagcagcagacctttattagtatatgtacgctagttcaacaagactatcacaaatagaaatttctgctaacagaaaacatggaatgttaaggcactaatgagcataagcccaatcagtccaggaaactgtaaacttcctcttggtctaggcttatatgttgatcttccttgccaactcatatttcattctgcaaacagaatactgtgattgggaaagtgcacttgagaggattgctgtatttgaccacttccatcgccatatgtaaacttgtaattttattaaaatttggaaatactttgaaagtaagtcccaggacaagtttaagtgtgtgtgccttctgaatcgaatgcttgcaaagccacttaaggtggtcaagttagcagtgtcttaaggctcctggcaaaagacacagggtatttctgatgaggtttagtttcacaactggactttccatagtggagacatataggaaaatacagctacagaattcaaattggagtgaacacagctttcgttacacatctgttagctaggcccattttccctctaaaatcaagttttgttgaaatgcacaacccagcccattcgaacatccatgggggagttgaagttgccacacagcactggccactcctcactggacacctatgtgggcactctacagacctcggggcctgggtcaccagcccacagcattcccacttcccaggcctgttccttcccacccaccctgccccttcctggttccccaccgaggagtctggaatctgtcttctactggggtttccaggggcttccaggactcagatacctccaacattaccttcagcactcgccccatcttcacctgagctacctccactctgtggtccaccttactcatgacgtcgaaggctttcacctgctgaggccagggactaggctgcctgaagctcaggaagtctgctggcttctcctcacattcactcacactacacctcctggggggactggccttcgcacctaccagctgtgtctcagtagaggagagagtctagaccacaggaccgccaccctcccaccctcacagctccacggcattcaccatgtggtcgaaggggccgactggaccatgcccagtgaacatgcccactgaggtacaaggagcatgtgcagtgagatgggtgcctgccttgtaggctgtggtaccctgcctcactgcattctccacttcctccaaggtatccactaaggactctggaatccatcctttttgggcagttagttccatatgctctaaggattcaaatacctcaaatagtgtcccccttcataactcactgtatgctcaccaggccctcctcccctctatggccctccttcttcccttatccggcacccccaagcagtgcatcgctgcctgttaggaggacaacaacctcaaggcccttctgcctaggaggctatagactgtgcccgcgggctcctcctcacactcactcacactgaaacttctgggacaactgatctgacagcagggcacatgggcaacaaggggtgtacacacagagtcaggcacatgcagggccagccagggttttcccgctgtccccagacccacatccacaggctatttctagtagaaagaaaatgacttaagagatctttttttttctctcttgccaaaccattctcagggggcccatggaaacatcgccacatgaacctcactgtccaggaagcttctttcacaacatagaccatggaaaaccctggcaggtataatttccacaagcatttgaacaacaggcactcccatctcttctgctctcccttgtatggctactgctagaatcttgataaatacccgtcccaggatcccttgcagagggtggtgtgccacagcttcccaggtgatgctaataatatgcacctcttaaaagatttgggaagtagaagtcattttcttatttcaccccaaaatggtcaaaggtgtgtatggtcaatacgggaatgtttgggcaggtgtgaatggtgaatctgaaaatgcttgggaggtgtgaatggtaaatggaatgtttgggcaggtgtgaatggcgaacatgagaatgcttaagcaggtgtgaatggtgaatgtgggaacgtttgggcaggtgtgaatggtgaatgctggaatattttggcaggtgtgaatggtgaatgtgtgagtgtttgcagtggcttcaggattctcctactaatcatctgtctcaggacttcaaggggcagataggtttggcagacgtctcctgcagttgcctgaacaggcatatttcactgtactccaaatctagtatgatttccatgataactgtgtattttatgagacttgattattcttccatactatttttttactgatgctgaacacatataatttaataacaagtgacttcatgataagaaatttccaatactataatactctcacaaaatacctcattcaaatcgaggaggggttttggcatttagtgagagtaatatggtattggaaacaggatgagagtgaaagtgagaagtaattctctcttggtcatgaattcaggttttgaagttctctcatcactgctcagttgctcagatatagacatcattacatggttattacattagtagaagaagcaggagtgctagcttataaaatagatacaataatacctccacaagggcactaaaagtatttctatctgtttgttaaggctgccatcaaaaactaccacagactgggtggcttaaacaacagacatgtattttctcacaattctggaggctacacgtctgagatcaaggtgtcagcagaattggtttcttctaaggcctccctccttgccttgtagtctgctgttttctcccggtgtccgccttagtcctccctctgtacatgtgtgtgtcatcatttcctcttcttataagggcaccaggcaaattgccttaggaccactctaatgaccccatttcacttaattacctctttaaagaccacacctatctcaaatatagttacattctgtggcactaggggttcagacttcaccatatgaattttgagcagacacaactcagcctatatggtactaaagacagtattaaaataaggctgggcgtggtatgaattttgagcagagacaactcagcctataacagtatgactgttagttttatattaacactgtttatttttgagacatagtgattcattcagaggacagaagcaatctgctgggaattatcagaggttcccaaacccagtctacccgtgtctgccctggcattctctgttgcccttctacatacaatgctcttaactgaagccagcccctcacctcagctcaggatccataccccccaccttcccaggggctttgctcctacagtgatcactcccctctcctgaaccatcaatggctccctctacattggatcattcccaaagctaagggggaactcaccttcttctcccatgtccttctgtagctactaacatgtttatctgctgcccttcaaaggaaaactgcctcaacttatacaactaacttcactggagtaaattttcaaagttacctagaaaggaaaatgagccagaacagccaaaaccattctgaagtataactttggggaactcacactacctaatatcaagagtcatgttaattctatagtaatcaagagaatgtggtattggggaaaaatcaacagatcagcaggaagtccagtaatggactcacagacatgataaactgattttcagaaaaggcacaaaggcaatggagaaattatcttttcgagaaactgtcttgttttactcctgctacttggccaccacattcattgtttttatccccctgggtcccttccctgtgtttctcctttgcacttcagctgctcttctgtttaagggtcttctgtaaaggtgccctcctccccccaccaacagtgtgacagcctccacagcaagtaccacatattgttggttggtcttctcatttccagcatccaagacatttcctataacatggcagtcatcaatgcatatctgttgaattaaattatcagtcttttgtaatgaccctaacagaaaagcatcccctctatttaggagtcattattggagatggtatgtttctaggcaccttacatatggttttgtgtcagacactatagggcaaaggctctgccatggtgtcttggagatcttgcaggtcaccacataggacacgtaggcaaagccagactgcaggctaacctgaatgttggaagaatacctggattccttttgttgcaaggggagataggcagcgtggtgggagctgccacaggtattttctcaccagctccctatctggttggaggttgacacgagaccattctttatccattttcctagtttccattaagcacgggcctttcctcatcttagggtacaactgtggagtataaaactgctcactgtcttagggtacagctgtgggctcctcacaggcagagagacccaccgtctgtgctgtcattgtatacctccgattcagtgtcatactgtgggactagggacacagtgctgacacaatgctgaccttgcttttactttgcctgcaatcaatcaaccatttggacccatttgggctcattgtcttcttattggtcaaatctatggatgtgtgacaagccaaactaacaacggcagtggggctccttgctgccgttagccactacaggtgtactgcttgaacacttgacacactattgtgttgtgtggtgttggctgaccagaaggacttattcttcacggcatcacacacagcaaagggcacagtgttcggcacattccattgacttagggttggccttgtcagactgcgtttattcacaaaccaactttagaattgatgtcatgtctgacaccagctaccctggtttttaattaatatatttatttaaattaagtaagtctcagaagtcaaattcatttaaaaaggtaacttgatacccctacttgaaatttaagagcagttattacttactaaacatgtggttgtaaaggcaaagggaatgaaaaaaattgaaattttaaaagaagaaatataataaaccaaatttatctacagtgtattgcctaatccatatgttatttcatttattcttcataacaagtatttagtgtaaatattctaattcctactttagaaatggggacattgcctcacagattataatatcttgcccaccccctcaaggccagtgtgtaagaggcaggatggaatcccatgggtatttcatgccatagcctataaggagacagtgtaggtaggacccgtcatcttgcttcagcaagttgccctggttccttgccgcttactcctacctaggccctaattctttcatctagctccatagcctagggacttctcacatattttgtggcaaatggaacacccttagaaaagatgcagatgaggggacacatagggtgaggtatgcagggaggggcagggagtttccatggcctctacgggcatgctaccctccatgtgttcagctagccagaagctctctgaaccgtgtccttttgggtttcatggaggttttcattatgtaggcatgactgattaaaatgttggcttgccattggtgaacaacttaaccttcagccccaaccttccctgaagtttgggcatggggctgaaagtcccaaccctctaattcctcatcctagagctcctagggactgccagacattggtcaactcactagcatacaaaaagacatcactttataggagttgtatgccagtaagcacagtcaatgaccaaatatacatttcaccataccacacttgtgtatcagctaactcagaatacaaaatatcaaaaatgatacttttttttgaaacagagtcttgctctgtcatggaggttggagttgcaagtggcgtgaacatgactaccagcatcctcgaccacctgggctcaagggatcctcccacctatgcctccagagtagctgagactatagttgcattcattcattcactcattgtagtagagaggggttcctatattccccagactggtgtcactttcctgagctctagcaatcctcctacctcagcatcccaaggtactgggattacaggtgtgagccattacacctggccacaattctcaatagtatcaaaatacctgggaatgaaattaacagaagaggctgggcacggtggctcatgcctgtaatcccagcactttgggagaccaaggcaggcagatcacgaggtcaggagattgagaccatcctggccaacatggtgaaaccccatctctactaaaaatacaaaaattagccaggtgtggtggaacgtgcctgtagtcccagctactcaggagtctgaggcaggagaattgcttgaacccaggaggcaaaggttgcagtgagccaatatcatgccactgcactccagcctggcgacagagcaaaattccatctagaaaaaaaaaaaaaagaaagaaaaaaagaaattaacagaagatgtgcaagacttctttggagaaaagcttaaaactttattaagatattttaaagtaaaatatctaatataaaaacagtttgtgttgtttcagcttatcttcctttaaacctgtgatttcccttcacctgtaatagaaacataacaggtggaacattactagcagaactgtatttagatcacattaagatatgcaaatgacaccaaagtttttgtttcgtacagtggactaagaccataaacccaagagtcaccctctggcttacattcaattagacctctgtggagactttggagataaacttccaaacatatacattattaatattttttaaacacaccctgctttctagtgctacaaggaaaccaaaagacagtccgaggtcagaacacattaaatcaagtgaaactcttaaaaagggatttaatgtataaagcaaaaattgtgtataattttactaaaaatataacaaatacacacaaaaaaactaagaaacaaaggaatttataaaaaatgtacaatttaatattttggcttgaaactatggtctggatgtcaaataggctcctggaaatagtatgaaaactatcttttaagaaaagagttaatgtcacattagaagctgcatatgcgtggtgaatagaaaggacagtattgcatttgttttttcctctattgtgccaaagtgcaaaaatgttgctttgggttagtttacccttctgtagatattaaggtatggtaaacatctgtccccagttttcacctatagtcctgatgttaatacaaatatctctttttacacttgaaaaaattcccctttgtataattaattatatgatcgcattacttttaatctatcattatcattattgatatcaaaatatgaaagaggtatatatcatgaacagtatggcacgaaaaaaaagaaacggaaagggaaatggagatgtagaggaagacatctagaataactaaatatttatttctaaaagtaaatattatcaagggacaactagcaaatttcacaagttcatgcacagtctttgtgatgaatagatattcaggtactactgggatatatttaataatgcatgcattcctagcttatcaaccatttcatctatattccgaaaatattagagtttaagaacgtattcactttcagctgggcgtggtggctcacatctgtaatcccagcactttgggaggccaaggcaagtggatcacccgaggtcaggagttcgagaacagcttgtccaacatggcgaaacctcgtctctactaaaaatacaaaaaatagccaggcatggtggtgcatgcctgtactcctagctactcagctgaggcaggagaatcacttgaacctgggaagtggaggttgcagtcagccaagatcatgctgctgcactccagcctgggtgacagagcgagactctgtctcaaaagtaaaacaaaagaaaacaaaagaatgtatttactttcagttatactacatattcaatatctgtgtcttcttcatattctgtattgtgcttttcccattttcttcaagactggagaaacaaatagatagtctattcatagctatttttaaaataaacaatgtgttaaatgtattacttttggattagttttcctaatccaaaatccaggttcctacctgtctgttattaagtacctctttccttttccattaggtttattctgttgctcttttattattatattgattattactttatcatgtaatttgctatctattctaataagatgtgcatttaaggctgtgatcttcctaagaatacaactgaggcttgttcaatcggctcctgaaaactatcttttaatgtaaatagtttaatggaatggttcagcagtgcagagtaaaacatttaggtaatttcttccctaaacatggagttcttcctttaaattcagaagctcttctcattaacagtcagcaatttataaaaaaaaatgtgtaaaagatacttatgttgactactcaagaattagtacattatagtctttgaactttaagtcctatcatctgatgtctcaaggcagaaacctgtaatatgtaacctatgatatggttagaggtgattatatcatgtgtgtctttattacacacagtagctcatgaagactgacaggagagcaaaaagcatgcttagcacaggcatcttacacccaccttgagcatgactgacctacatgcattctccctacttcattggccacagaaagtagactgtctcttgccattttattattcagtcattcaaggcttcacggtgggaaggctttaaaatacaattattctttaaaagccagataattcagaatttgacaaaatccaagaacactcattcaagtctccatgctggaaaacaaacatcaagcagagtgcctgctcattttcttaggagcaatgaaatctcagctcagatattgtaattggactgaagctgattgttaggaaaaacaaatcatgggaatcagaatatctttctattctctccaacagaaccagagcatgcagaaatcagcattgaaacggattttaatacatttgatctgcattcaccattttcaataacagcaaagatgggtgtagaatttatggaatttgtccagattctcacaaattgtcatagagctgctactagaatctccttcagtactcagcatatttcacacagtctggtattacaaatgcattatgtatttgttaaaagcagaaattagaaaagaatctgaaaattgttagctgttggttatactcagaagtaagaaaatgctgtcatatttgatgattcaatatggctttgacccaatttgtgtctgtatctgagagcatttaagtcttgcagtcaggcattgggatctgaagtacctttcaaagaaagtgtgtatttgaacactgttattaaagtggcagtaatattatctctctatgatcaaaagtataatattgtaaaaaatagaaatcacataactttgtgtcttaatgaataacacacctgcttctggcattttaaagtgctctgcttttggtagaatcttccccttgacatcagtaccaccttcacatccatccccagtctttgtctgacatagctcctggagatcggcttccaggtcaggcactaaaaaatacaaaggttattgaacttgagtacaaaaacatgaagtataaataaggaagtaataatattctattccacagagttatgacataaaagcctgtaggctagtgtgataataaatgtgatgcaaagctgtcacacttttgttttcctgtattatgaattcctattttatttgttttttaatacagggtttcactctgtcatccaggctggagtacaggggtgcagtcacaggtgactgcagccctgacctcctgagctcaagttatccccctgtctcagccttgtgagaggctgagactataggcacatgccaccaccaaggctaatttttgtatttttttggcagagaaaattttctggtgtttccccatgtttcccaggctagttcctaactctcaggctcaagggacccaccagcctcggccttccaaagtgctgggattacaggtgtgagccaatgtacctggcctgaaatctaatataaaatgacaatctaaggataaatcacactacaccttcatttcctatactttgccagtgtgcattataaacagtgagtatcaactatgtaagatatctgaagtttgctgcatgaatagcattttaataataactcaaagataattttctgaaagactagatcaatgtattcctgggcttatgacaaaaacttacaattgtgacaaccatatcttgctgaggtaatttgaaaattatttggttaaaattaattaaaattatgcttaggtccaaaggccctaaatgtaacttttcataaataaatcctattgagaatatagtaccaaaaataagaggaaaaaaagtcacagttttcccatgagaattcaggaaattgagtgaaagaaagtaatgagtgttgttgacagtcatattctggaaacctcttaaccgtgaactgctaaaataatccatggtccaaattccgtcaactttagcttgaaaatgctatctgttgaggacacaatttctgtttcatgataattgtatcatactttgagttttctaattataaaagtatttaggcaacttttaaaagttccttaaaaagcatactaatatacctacctgtatgccagtgtcctgaactatccaccttttaccaaacatactgtcaaaaaatactgatcaaagggaacagtggctgtcattcattgagcccttttccggatttgctatcctgcttcactgaatttgttttctcctgagccaatactcaagtaccttacagtacagacacattcgagtattaagcgttttaagcaaaataattcacgttttctaataacgtagatgttaggaagaacacagaccttggaacgtaatatgaattctgcctccatgactcaagcgttcttggtaagcctctatctctgagcaaccatttcctttttataaaatagggctaatatccctatgcaaatgggctttattcagggtgttataaggtagggtgacttggcactctatatgctataaaagggtgcttataacactgtggacaccatggctgagccaatcatacagcaacattctaagaagatcaaattaatcaagtgaaataatgtacattttgatacatcaaattaaacagtttcatctgatttagcaagggatgtattttcaagcatacaaaataaatcttgaaaaaaagagaagatttattatatccagggactgcatgaagctgcaaactatactcttcacttttccagcctactttgagcaagtgcttgagatcctttcctaatgttttctttcctcctattactggtcatggcataaggcatgatggacacataggcctccttccccctataggcattatttctttcctttcccagcaccttgaatctcagctgcaccctgatcatcttctctcttctgatcaggtgtaggattccgacttttagtgggtggtttctcttctttaggctcttcatcagtgggttcctgggacaaaggggaggcagtatgtgtgcagataaaaagttttgttagtaatacatgtcaataatacaaatatacagaatacacaggtatttctaatcacaagtaagtctaaagacacttctccaacactgttccacatacttattcttcacaaagttactcttcccaaagagaggttactctaagacagttaccctcaaaggctttggaaaccattttaatctatgttgggttggatgtgtgcaatctgttatcagtaagcatgaggaggaagtcatgatggggaacacaagattatccatgaaggcaaaatcagattgtaatactcttggattagtctttccttcatgagatgcatgatcatttttatcaacatggaagacctttatcagtgtatctatactagttcaacaacactatcacaaaagaaatttctgctaataaaaaacatcaaaatattaaagcactcacaagcatagccccaatcagctcaggaggctgtaaacttcttcttggcctaggcctatatgttgatcttcctcgccaactcatatttcactctgcaaacagaatactgtgattgggaaagtgtgtttgagaggatagctgtatttgaccactttcatggccaaatgttaaatttcagtttttaaaaaagtttggaaataatttgaaagtaagtcccagggcaactagaagtgtgtacatcttctgaatcgaatgcttgcatagccacttaagttgggcaatctagcagagcaatgtcttaatgctcctggcaaaagatacaggatatttctgatgagatttggtttcacagttggattctccatagtggagacatttaagtttatacagctagagaattaaaactgcagtgaccacggctttcgtcacacacccatttgtttggacgatttccctccctaaaatcaaggttttgttggaaagcacagtcccgcccattcgaacctccagggtggagttgagaagttgtgacacatcactggacgctcctcgctggacatttctacccggagctctacagacctcggggtcgcggtcaccagctcatagcattcccacttcccaggcccctttcttaccgcttacacagcccattcctgggtccctaccaagaagtctggaatctgtcccattgggagttccaggcactttcgggactcagatacctccaacagcaccccgagcattcaccctatcttcatctggctccccttcactccgcggcccaccttccttatgacctggaagctttttactctctgaggccacagaccacgccgcctgaccctctggaagcccgctcactcctcctcacattcactcacatttcagttcctgggaggactggcctgcggacctataggctgcgtctcagtaggagagaaagagtccagacggctggaacgtgcccctcacactctcacagctccccagcggtcaccacgtgggcaaaggggtcgaagggaagatgcccagtgaacatgcacactgaggcaggtgtccaaggaacatgcacactgaagtcggtgcctgcgttgtgtgctgcagtgccccgcctcgccccaccccatcccgcgtcatgcagtcctccctcccctccctggttcccactgaggactctggaatgcatcgtctgtaagcagtttcatatgcctcgcggactcaaataccacaaatagtttcccccttcaaaactcactgcttgtttacctgaccctcctcccatctatggtccttctccctcccttgtccggcacccccaccacagcaaggccatggctgcatcgctgcgtgttagaaggacggggacctcaaagcccttccacctaggaggccatggatcgtgcccgcaggctcctcctcacactcactcacactcaaacttctaggactactgaactgcagacctactggctgactcctagtcggcaagacagaaggaagtcacgatgtctctttgcacagctctgctgggacagaaggcagacagtaaggcgcatgggcaacaagggacttgggcagtaaggggcgttcacactgagtcaggcacatgcaaggccagccagggttttcccactgtcccaaaaccagaatccccagtatgtttgtagtagaaagaaagggacttaagagatatttttttttctctctctcttgtcctaccattctcatgcatccagaaactttgggaacagagagtcccatgtcacccttagtggttgatgtgtctcagaaagaccttttgtgacagaaataaattattttaatgtttatatttatacatgctttttttttccagacagggtgttactttgtcgccctggatggagggcaatggcatgactttacctcactgcagcctggatctcctgggcataagcaatactcaagacgcagcctccgaagtagttgggactacaggtgtgtgccaccatgcccagctattttatttatttatttacttagagacagaatctcactacattgtccaggctggtctcaatttctgggatcgagtgatcctcccaccttggccaatttttattcatactttgattaatcacttccttctctggtctgaggttttctgccatgctaccaatgaatagaaccacttctgtagactaaataaattcacacctcttccttttttaggtggtattattgcacattttaatctctggactggtaactgatttccctgaatatacctgtaggtcattcagacagtgtatggttcagaaatatccatacatatgatgtggtttgactctgtccccacccaaatctctccttgaattgtagttcccataatccccacatgtcatggaaaggaccctgtgggaggtaatgtaatcatggggtggttaccttcatgctgttcccctgatagtgagtaagttttcacaagatctaatggttttataaggggcttttccccttttgctcactcttctctctcctgctgccatgtgaagaaggatgtgtttgcttccacttcttccatgattgttaagtttccagaggcctccccagccctgcagaactatgagtcaattaaacctctttcctttataaattacccactctcaggtatgtccttatagcagcatgagaacggactaatacaacattggtcctaggatttaaacttagtttattgtgacatgatgtacagcagtggtgactgtgctcatcatatactctactccccaaatagcagccaaataacctgttcataagacagcgctgacattatttaaataaagctataaggtagagcactacctccacagaggcactagtatgtcagatgtggaagggctttgggtatatttgttgtgcttttcatgtccggtataaagtgggtattttaaagtgggggatggtttggttagaattgggtaggaatgacaatgatttaggattggtggatgcaacaagactttttaggcaatgggttcaaagagttttgggattgaaaaatgtcatttgacactttttattgaggagttgatggatctttcaggcaattgctggaaagaacaataaagtttttttgaaacttttattttccttggtaagagattcctgtattagtaaaattatgataatgaagacagtggaatataaactcttgttaatgtagacagtaaactatgtccatgactcctgttcttattacttttatattacctagcagttaatgtggggaatagtatatggaagggaaggataggaagggagccctgatcagaatgtagccttttataaataaattaggatatattgttgaactgacatctatatattctatctagttgagcttctttttttttttcttttgagacggagtctcactctattatccagactggagtgcagtggcatgatctttggctaactgcaatatctgccccccagattcaagtgattctcctgcttcaggctcgcaagtagctgggattataggcacgtgccaatacacccagctaatttttgtatttttagtagagacggagtttcaccatgtgggccaggctggtctcgaactcctgacctcaagtgatccgcccacctcggcctcccaaagtgctgggattacaggtgtgagccaccgtgcctggccacagctgcactccttttaaggaaataccctgagtaggaaaaaagagattcctcaatctctgtctccaaaaagtggcttgagtagtcattgtagttctcaaagtttatttaaggagtgagggcactcataaactattatttagtttatctgttatcttttttgttttttcttggcaaggacattgtcattactaaattttacttgcatttttcccttattaactccggtttttagtatagtgcactcagaaatgttcaaagaatgagagatagtgacatctgggtttagattttctgtgagcatcgaattagcaaatggtcaaagtcatgccatcagatggctggatggatgtgcttcacaaggacctggattttaatgattcctgagtggacacactccagcttcaaagggcaggttttaacttcctcccaaatttgagcttcctcctgttattcccatggcaggtgaccctggtccagctggatgagttcaaaggatcataattggattgggatgggagcaagttgtgaagtagcccttgtgacactcacaggaagcagcagaaagtatgagaaactctttagaggcaagaagacttgcctgatacatgacgctagcaactctgagggctgctaaaggagaagttggagctgggaccaacacagcccatctacctgtgggtgggctcaatttcaccacatgacaagaccttcccatcctccaagcactggaatatgaacaaactgagatttccacaggactgtggctgggtgggacaaagtctacagattctgagcagctggcagttttcagagtaccatagtaaacactgtcacctgagctcttcagattgcttgttggttgaggtcaaattatttactacctaccatgttaattgcaactcccctatttgcctcataaagcgggagcacaaaagggaaatggaggtccctgtgcattcacagggaggtccgcgtgaatggatgcaattcatgacattcagctatgctgcagcccaaacaaagcctcctcatgataccaagaggacaagaggtcacatgtactttctgtcccttttgcatgtgattttatgtctgtccaagtaacacttcacctgtgcaaaacagacatggttatctgctgatggaacacacatttcctctgtaattacatatttcgtggtagcctttgtggcccatatcaaagaccacgtttttggccaagtgcagttgcacacacctgtattcccagcaatttgggaggccgagaagggtggatcacttgaggtcaggaattcgagatcagcctggccaacattgtgaaaccccatctctactaaaaatacaaaagttggccaggtgaggtagtgcagtcctgtaatcccagctactcggcaggctaaggtgggagaatcgcttgaacctgggaggcagaggttgcagtgagccaagactggggtgacagagggagactctgtctcaaaacaaaaaaaaaaaaaacaaacaaaaacgaccattttttttctgaaaagactgaattccgaaggaggaagacaacattgggttctcatgtgtcttttcatatacttctataataacacttattaaccattgaggatatcttgtgaaaaggctttaatcttttccatactggtttgtcatccatagtggttcataagattaacgttgtcctccacaaacagcattttgaagaaatgagataaaataaattagtaaatagcattcactgcatatagaatattcaaacagactgcacacacacatacacatacatatatttatttccctactgaattatatacaaactatgtatttcccatgaattgtaatttaaaaagtttgaaggtcattactttagaagttattggacaaaatgtctagggacaatttctttagccattgatgaggatgatagattaagacttgctaagagcaagttcactgttgtctgtagctttctacataatgcttgaaatagctctgagtgatgtttaaatttgtcagttttactgtgagcatttgactctcagcaaactcacttgtggactcatgagttggtgagaaggaaggctgatgagttgtggggctttacttcccaccatgtctttctgcagctgcagggtgtgttcatgtgtgtgcttctgcactcgtgtgatggtgctttgatatgttcccttttatttccccctttattattgattgtgtcttatggttcctattatgtactttattggcatccagtgacagcaacatctgtggtattcagttttgatccattttacatgtattcaaagatattttcaagcacgaatatttattcttaaaaacttttccttacataattggaggagttcaatgcaattaaatatcagtatttgatgttagatcttattgggcaataatcctgctaaatttttaatcatactaattcctgttacacctgagcttttatgtcgccataatgcttagataaatgacacattgactatgacaaagatgaaagatttttaacaaatcaacttgagaaatatgcaatcatggaatatttggaagcgttctcctcttataactgatgcaagacaggtgagcccagatttggagcttagcccaggagggttcttggctttgcccaggagagaattcaagtgtgagctggtggtgttagacagcaatacttttattgaacagtacttctcctttccaagtagggctaagtcacaggcagtgagccagaagtcagcaacctatgggctcttggcaactgtatttatactcgtttatacctactttaaattatgagtcagtttaacgcaaattgaggggtgggttatttagaactttctaggaaaagggtgccagcttctgtgtcattgccatggaaagtggtagtaactaacttctgggtggttgccatggaaaggggtggtaacttctggaatgctgccatgtcgtgtaaactgtcatgagtctgttttatgctgataagcaatgaatgcagctagggattgctcttatcgccatctgctgcttcatgcgggtttcttcacttcatcctctcgggaccaggaattaagtcctgcgtttcttctacttcaaaactacagagggaatgtagtgttttctttctcattaaaatcaggtatccctttaattattggcatatttctcattgcatacagtcattcaaagtttgcattttatacaaagtcttgtcctaaatcttctattcagcttcactttcagcttaggatgtttaggaagaccaagtagccaaatttgatgccaacaagatttccgggatccctgtactaggtgtgatccttatcattcttatgtgaccatcatatctaatcaatgacacatcatcagtactataagcaagccataacacttggagttgtggttatcatgtgagcatttgctttcaatgataggtaatatttttagatgtaactctgaataaaaatctatttatatgctaaatatgttgctatactgctactccgtgaaagtacaaatgtatatttgtcataagtagagtagcattctgaaataattaatgatgattataaaaactcctaatattatgtttagaaacaaagaaaaaggtttcaaatgattagttgggaaatagattgacagttccataaaatattaagagagcgaatgcgagtttgaaaatatttggaagaatgttatgtgctttttaagtggaccaatgtttctaaaatgtatgcatgataacataaatatgtctttacattaatataaattattttaaacataattaaaaacattcttttgtatcttgagtttttcatgttgcttgttgaaaaattataaaacagaaaattataaacaaaaaaatttcagcaatgggtgatttataaaaatacccattttactgcatcattatgaaaaacatccattgggtatttcttgttttttcaaaaataattaagggttttctaatttgactgagaaaatttaatgtcatttttactttattttttattctcagattactagaaagtgtgtaagtgatcatatatctttgtaatttgaactgtttgggttctaattttctactttatttttatatttacttttattatttccactgagctttaatttttttttcatttcaagggtttttttttttgttttcttttttgagacaggatctcactttatcacccagtctggggctcaccatgtaaacatgactcactgcaccttatacctccagggcttaatcttcctgtctctgctccccaagtagctgggacaacaggtgcacaccaccacgctcggctaatttttgtatagctagggtttcaccatgttgcctagactggtctcgaactactgagctaaagcaatccacgcccctcaccctcccaaagtgttgggattacaggcgtgagccaccgcgcccggcccatttcaagacttttgtgtgtgtgtacaaagaatatttacactgtcatattatataaagaataatttttctgtttatatattgttttaaggttgttgatggctttcattatttttttcttttttaagaaatgtttcattaataaataataattatatatatatttatggggtacaatatgatgttttgatatatgtgtacaatttaagagatgagtaaattataaaagactggatagaagtgcaacaaattgtttaccacagagtggtgaaattgtggatgttagttttgattctgctattccatattttataattttctaaaaaaaccatctactactttttaatcagaaaagaaataatatttaacatcaagaaaattaatattaagtttctttacagagtatacaaccacaaatctttgatgaaataaatagtaatgtgctatcttgagtacattttcttggtaaagacaattttcctttttaggtatcatttggtgggtggaggatagagagtaccttggattctgattttgcttggttaaagttaatggaatgtagctttttgtgccagaaagaaggctatgatatttgctgtaatagcatgtcctgacatctatcccatctttatctttattcgttttatcactgcagtgaaggcaaggaatcatggtgttcagtcagcagacaagaaacaaaagttcatcactctgaatgctcaaggatatctctgcttttcagagtagccacttaggagtctgtcatctgtaaatgtgccttagtctcttccaaatatatttatattttctcatctatcattatgtacatggggttcagaagttggctatttttatataactctttttgtgcaaaacttacataggttggctcctttactaactcccaaacttctccactatcatgactatggagccagtcccttttctgtgaaagcaacatcaatgacattgattcttctactaatgggttctctggtttaactattacaacaacctgaaggaaccaaaaacctgtggcatgtgtcttagtgggcactgagctaagagatgaaagaaattccctcttatttttttctaccttatactcattgaatatcacatttaaaagaaatttctaaaattaaaattggaataaaaacattataaaactggcattggctacactatgcaactccaagcagttaacaattgtgagaaactttctccccaaaaaagtgaaaattacctttttactttgctgtttttaatagcaaaggtgcgtttctgtagtcccagctactcaggaggctgaggtgggaagatcacttgagtttagaaggtcgaaactgcagttagccttgatcatatgacatagattgagaccttatttcaaaacaaaagcaggacaaaacaaggcaaaagatctgaatagatatttctcagaagaagatatacaaagggccaagaggtatatgaaaaaatgctcaacatcactaatcatcagggaaatccaaatgaagaccaccaatgagatctcatctcacacccgttagagtgcctattatcaaaaggatgaaagttctggtgagaaaatggaacacttgtacattattactgggaaaagaatatggaggttccccctcaaaattgctagcccactactggatatatatccaaaggacatgaaatcagtatgttgaaaagttatctgcactcccatgtttatgaagcattatttacaacagccaaggtatgaaactgctgcaggacaagtgagcctcaatattgtggcttaatctaggatgattcttgacttcacccaggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaatttctttaattggtataaacactatatatgtcatctatttctttggggggaatgaggtttgctagctagtgtccttcaaggaatcttcccactccatttaaaaaataatattttggatagtgcttttcaccatgttccctatcatatatttaatatctgaatgatttgtattgatgtgccctctggcgctactgatatctgtgatttgtattctctctccacttctctcatcagtctgtctaaaggtttattaatttgactgttcctcccaaacaagcgacttctggtttcactgatttttttaatagattttttcatttctatttaatttatttctattcatatctttattaatttttccttcttgttgttttgggtataatttgattttatttttccagtttcttattttatttatttgtttaggttttttttttttttcatagacagtctggcactgtcacctagactggagtgcagtggcacgaccttagctcactgcaacctccacctactgggctcaagagattctcctgcctcagccactatgcccagctaattttttttttttttttttttttttgagacagagtctcactccttcacccaggctggagtgcaatggcacgatcttggctcactgcaacctccgcctcctcagttcaagcgattttgctgcctcagccacttgagtagctgggattacaggtgcgtgcccccacacccagctaatttttgtatttttagtagagccagggtttcaccatgttggtcaggctggtcttgaactcctgaccttgtgatctgcctgcctcggcctaccaaagtactgggattacaggcgtgagccaccatgcccggccaactgtttttctagtttcttaatgtggaagcttaggtaattgacttgagacatttcttcctttctgatataagtattgaatgctataaatttccctctgtgcactgctttactgtgttatcttgcattttttgataggctgtgttttcattttcaaattttctctacaatttattctttcatccctgcgttacttaaaagtgtcgtttaatttccaatatttcagggattccgtatatctttctacaactaatttctatttcaattcttttgtggtcacaaaacatgttttgtaagatttcattcctttagaatttgttgagatttgttttttggcccataaataaggtctatctcggtgaacattccatgtgcacttgtgaagaatgtatattctgttgttgttctataaataacaattaggccgagttggttgataccattgttcaagccttctgcatatatatatatatatatcctgattttcttgtacactgtttctaccaattgctgagagaaatgttgaaatctcctactataagtgcagatgtgtttgtatcttctttctcatgtatgggtgttcccctcatgtattttgaatataatatgatatataattaaatacacctaatgtatttaattattttttcagatgcagggtgttactgtgttgctcaggctgctttcaaacacatgggctcaagtgattttcccattttggccaatttttatacatgctttgattaatcacttccttatctggttctgggttttcaaccatgtgtacaatgaatttaactacttctgtagactcaatcaattcacacctctacccttttttttaggttgtgttattacacatttaaatctctcgactggtaactaatttccctgaatacctataaggtgatcatgggctcagcagtcagtgtgatttcaacgttggctcacaacagcttggaaagcctgcatgggaagtattgcttgaggaaaagtggagagtttccaggaacagttttgaaaaacaaagacaaccgatgtcatccttccctcccttgcctctcctcatgtgccaggttttctgtttcctccagctgatagaaaatcagcatgaagtattctgtgatgaaaagtttttatccctttaatcatcccgtttcttcctccaaaccttttattctttctggaagggtggtatgcagaaggaacaaaagcattttcagaaaaacacattataatataaatttagtgaaaagattcatcatgtttaagaaatggtcaggatgaaatcctgaatttgtaaaaattgtaaaaatcagtttacataacctccatcccttttgtctctatcacttatccagtgagaagtgtagaaaagatgaattccttatttgtggctgctgcgttgagtagccaaactgctggccaccttccatcaatatcatatatccagatgtaatagccacaaaatgcaaggcctgtttaaaactttccctgatttcatccatctcattgaaatttccatcaaactcctagcagtaaattcagcattcaaagagttacaagtactgtggctaagagagatcctggctcaaatgttgggagggggctgtagcagtgggcgcccagctgaagacaaggctggaatgtgtcttcacaaccccccccaccctttttcagacaggatttctctctgttgcccaggctggagtacactggaggactcacaactcactacgacatgaaactcctgagctaaagtgatcctcctgccttaccttcctgaatagatgggactacaggcatgtgtcaccatgcccagctaattttttaaattgtgtagagcaagagtctcactatgctgtccaggctggtcttgaactcctggcctcaagtgattctcctgcctcagcctccaataatgctggaattcctggtgtgagccagtgcatgcagccacttttacccgccttttaaaatctaaggcttaagggttttctgaggctttgctccaacccaggaagctgataattttcctcccacttggatgaaagagcaattcaaatgttcaggatttttggcctgtgcaaagctctttggcaattattgagtcctttgtctacctgcctgcaggagaaaacaaaaattaacattagcatgaggctgcacctttcccccatatattatctggagcagaacagtggttaagggatccagggatccagctctcttgcagttggagggactattgttaaatgctgtgagtacatgtatttttcataatagacaacagcttcggctgctgcttcatattatgggtaaatccatggtctcccaggcatgacagcttcatcatgtctaccccttcactcttcctttattcaaacaaggctttcaccatattgtatgcagttcctaatgtgacattaactgatttctccaaagatacttttcagggtatttccaggagcctattaggcatccagaccgtagtttgaagccaaaacattaaaagcaagtttacagaaaaagtacacattatttgtaaattcctttagtttcttaggtattttgtgtggtgctgatattttgagtaaaactatgcacatgttcggaccttggactatcttttggtttccttgcaggactagaaagcagggtgtgttttaaaaatgtttttaatgcatatgcttggatgtttatcgtcgaagtctctacagaggtctacctcaatgtaagcaaaagggtgactcttagacttctggtttttgtccactgtataaaactaagattttggtgtccttcccatatctttaatttcatctgaatataattcccctagtaatgttcccaacttttatgtttctattataggagaaaggcaaccacagttttaaacgaagacaagctgaaacaacacaaactggttttatattagagatatttgaattaaaaatatttcaataaagttttgcaactttcaccaaaaaagtcttgcacatcttttgttcattttattcccaggtatttgatactattgaaaactgtggcttgatgtggtagctcaagcctctaatcccagcactttgggatgctgaggcaggaggactgattgagcacaggagatgagaccaacctggccaacagaaagagacccccttttttaaaaaataaaagaataaatacatgaatgtatgcatatatgtatgtagctgtagtcccaggtactctggagactaaggtgggaatgtatgcatatatgtatgtagctgtagtcccagctaatctggaggttaaggtgggacctcttgggcccccaagaggtccaggatgtggttaaattattttggaatggagactcaatttcaaaaaaaattaagaatcatttttgaaattttgtattgtgattgagctggtatgcacaggtgtgatattgtgaaacacatatttggttctagaccctgcttccaggcatacaacgcctacaatttttagaatctccacaaagtggtgtctttttgtatgctagtgaattgactgatggctagcagcacctaggtagctctaggttggggaagaagagagttgggcctttcagccccacccacaaccttcagggaagggacaagggctgaaggttaagttgatcacaaatggcgggccaacagtttaatcaatgacacctacataatgaaaaccgaaaaggacatggttcagagagcttccctctagctgaacacatggagggcagcttgcgcatagagggcatggaagctccctgccccttcccccgtacctcaccttatgtgtctcctcatctgcttcctttgttacgatatccaatttgccacaaaatatgtaagaagttcctaggctgtagaactggatggaagaattagggcttaggtagaagaaaggggaaagcaaccagagcaacttgctgaagcaagatgacttgggtcctacctacactgtctctttagaggctatggcatgaattagccatgggtttccatcctgcctcccacacactggccttgagatggtgggcaagatacttgcaatatttgggaccatttcctcatttctaaagtagaaattacaatagttacactaattacttgctatgaagaatcaatgaaataacataccaagtaggcattgctttgcagttaaatttggtttactagatttccttgtttcctttaagatttcaaactttttccttccatatttctttaaaactacatctcttgtatgtgatatctgcttttgaatttcaagtaggaatgtcaagttaccttttaaaatgcatttgacttcacaaaattatttgatttcaatgaatatgttaatgaattagcagtgtagctggtgtcagacacgggatcgattctaaagtggatttctaaaaaactgaggtgtgacaaggccaaacctaagtcaattgtccgtgcagaaaacttgtttgctgtgtgcgatgccatgaagaataaatcaatattctgggcatgcaatgccacacaactcaatacagtagtgtgtcaagtgctcaagcagtccctaagcagccctggccacaaggatcaccactgcagttgttagtttgccgtgtaacatattcatagatttggtcaataaggagataatgagcccaaatggatccaagtagttgattgtttgcagacacaacaaaagcaagagcagcattgtgtaggcaccgtgtccctagtcccataatacaacactgaatagcaggtactcagtgacagacagcacagatggtgggtctctctgcctgtgaggagctcacagccataccctaaagcagtgagcagttttataacaagttaggataacagctgtaccctaagttgtggaaaaggcctgtggttttctgaaactagagcaatggatgaaaatggactccaatgaagtgaagttgtataagttcatgaagttttgctgtgaagggcagcagataaatgtgttagtagctacagaaggacatgggggaataaggtgagttcctccttagcttggggaataatccagtatagagggagccgttgatggttcaggggcagaagtgatcattgcaggatcaaagcccctgggaaagtggaagttatgtgatcctgagctgaggtgaggggctggcttcagtcaggagcaattgcatgcagaagggccgcagagaatgccagaacagcacaggtagactgggtttgggaagctctaagagttcccagcagattgcttctgtcttctgaatgaatcattaggagaggtcattcaaatggaggagggttcctggcattttgtgagagtattgtagtagtggaagtaggaagagcatgaaagggagaaaattctctcgtggtcatggacttaaggtaaaataattcagaaggttttgaagttttcttatcactgctcagttgctcagatacaggcatcattatgcggtcattaaattagtaggaggagcagtagtgctagttcataaaatagatatgataatgctcacctcctgaggggcactaaaaggatttttattcgtttgttagggctgccatcaataactaccaccgactgggtggcttaaacaacagaaatgtattttctcacaattctggaggctacatgtctgagatcaaggtgtcagcagagttggtttcttctaaggcgtccttccttgccttgtagtcagctgttttctccctgtgtctgccttagtcctccctctgtacgtgtgtctgtgtcctcatttcctcttcttataagggcactgggcaaattgccttagggcccagtctaatgacctaatttctcttaattacctctttaaagaccccacctatgtcacatacagttacattcttaggcactaggggttaagacttcgccatatgaattttgagcagacacaattcagcccataatagtattgctgttagctttatcttaataccgttttttatttctgagacagggtctcattctgttgcccaggttggagcgcagtgatgttaatgtgggttactgcagcctgcaactcctgggctccaggggatcctgccatgtcaccctccctattagctggtagtacaggcatgtaacagcacaccaggctaatggtttaattttttttttttttttgacatgggacatcccactatttttcccaggctggtctggaactcctgtgctcaagtgatccttctgcctcggcctcccaaagtgctgggattacaagcatgaaccaacaagcccagccttattttaatactatcttcactactattgtcactatcatttattttattcttacaattacctggaaaggtaggaagtagtcactgaagctcacaaagttcatctattgctgaacctcaccaggaaaggaagtactagtcaaacagacaaacctcatgtgttttcaagtggagtgtaactgagaaagtcagatttgttagatttcttatcatgaatttatttgttattgttaaattttacatgctcagcatcagtaaagaaaagagtaatgaaaaatcattaagcccagagataaatccacacacttacgctctattgatttttgacaaagatgccaagcacagacagtggggggagggcagctttcaataaatggtattggagaaattgtacatccacacgcagatgaatgaaatttgaccctcatctctcaccatatacaaatcataaacagagggaggctggtatgttgcttcatctgggaacttataaagatttattgactgctttggaaaattacatcactgcagggcattccattcctggattctgctctgacacaacagtccaatatcagtttactttgtcgttgtgcatgcctgggggaaagaatgatgggaatccaacttccctaccaacatgaccttttccaggatcagcttcactgtattccttgtttttaaaaaattaagtgttttctactttgatggagaaaattttaatctcaattttgccttatttttcattctaaaattactagattgcataattatttccatagctttgtactttgaattgttttagtactaattttttattttattgtgttatttattcatcttgttacttatgtagtgctttaaatttatttttcacttcaagagtttttttgtctgtgtgaagaatatcaactctacatattatataaagactaatttttctgtatatatattgttcgaaggttgttgacttactattttttcttttttaaaacctgtttaattaacaactattatatgtatttatggggtacaatgtgatgttttgatatatgtatacaacttaagagttgcatcagttataaaaggtactggatagaagtgcaacacattgtttacctcagactggagaaattgtggttgttagtgtttattctgctattccatattttacaagtttctataaaaagcatctactacttttttaatcagaaaagaaatattattttacatcaggaaaatcaatattaaattccctcagagagaatatactatcacaaatctttgataaaataaatagcagtgtgctatcttgaatacattttcttggcctattagctggggttctctagagggtcagaactaataagagatatatatatatatagctcctatatatatatgtatatatatatatctcctatatatgtgtgtgcgtatatatgtacatacacatatgtatccacatatatacatatatatacatatatatatatgagtttattaagtattaactcacaagatcacaaggtcccacaataggccatctgcaagtggaggagcaaggaaagccagtctgagtcccaaaactgaagaacttggagtccaatgttcaagggcaggaagattccagcatgagagaaaggtgtaggctgggaggctagactgctctagccttttcacatttttctgcctgctttatattctagccgcactgacaactgattaggtggtacccacccagattaagggtgggtctgcctttcccagcccacttactcaaatgttaatctcctttggcaacaccctcacagacacacccaggatcaataattttcatccttcaatccaatcaacttgacactcactattaaggtcacacttggttatgtcagttttcctttttaggtatcatttaggggtggaggatagagaggaccttagtttccatttttcttggtgaaagttaatgaatgctgctttctgtgaaagaaagaaggctacaatatttgctgtaatagtatttcacgacatcaataccatctttatctttatttctttcatcattacagcaaagggaaataatcatggtgctcagtcatcagacaagaagcaaaagtccatcaatgtgaatgccagaggatatctttgcttcttagagtagccgtttagcagtctgtcatctgtaaatttaccttagcctcttccaaatatttcctcatctatcatcatttaggggttcagaaagtggctattttcgtattttttttgtccaaaacttacttaggttggctcctttactaactcccaatcttctccactataatgactctggaaccagtccctttgctgtgaaagcagcatcaacaacattgattcttctacctcagacccactggataacataattaatgaaatttttaaacttaaaattggaatgaaaacaccatagaattagcaatggctaaattatgtaactccaagcagttaacaattaagagaaactttgtccctcaaaaagtgaacattactttcttctttttgatttttctcagaattttttctgaactgaaaatgtaacaaattcataaaggccaaacacaggcaaattttctattttttaatttttaatttttatgagtacatagtaaggtgtatatatttatggggtatatgagatattttgaaacaggcatacaatgcataataatcccatcagggcaaatgaggaatctatcccctcatgtactttgatttttaatccaaaatgttaattctgcctttaagtttttttctttttttagcatccatttttttttaagacagtctcactctactgcctgggctggagttcagtggcgcaatcagctcactgaaacatctgcctcccacgctcaagtaattctcctgcctcagcctcctgagtagctgggattacaggcacttgcctccagtcctggataatttttgtatttttagtagagacgaggtttcaccattttggccaggctgatctcgaactcttgacctcaagtggcctgcctgcctcggcctcccaaagtgctgggattacaggtgtgagccaccgtgcccagccagcatccatctttttaatgactattttagtcttaaaaacaataaatttctccggacgcaattcctttgaaaaaaattatgacaacattaaattgaattatgcaattttaaaaattataatgataaatttacatgtctctgggctgggtttgatggttcacacttgtttttgttttgttttgttttgatggttcacactggtaatcccagttcccatgggaggtcgaggtaggaggatcacttgtgcccaggagctcaaggctacagtgaagtagcaacacaccactgcagtgcagcctatgtgacaaagccagaccctgtctcaaaaacaaagaaagaaaaactttaattaatttatatgtgtccttaaccaaattgcatatcctttgagggaagaggctattgagcatccttttgcctccccgtaacttctaacacctaaacttataatgatggatcaattctccaaaggaaagaatatagagcaaagctaaggaatacatgaaaactgacagagagaagcaaggacaataaaattgaggaatataaatccggaaagagaactgaagtattatggcatccccaaaatagacatgtgacccaaaggaacagaatagagagcccagaagtaaatccatgcacttacggtcaattggtttttgacagaggtgccaagaacacacagtaagggaagggcagccttcaataaattgtatttggaaaatgatatatccacatgcagaggactgaaattccatcctcatctctcaccatatacaaaagtcaacttaaaatgaattaacattgtataatgtaagacctgaatctatgaaactactagaagaaaacatagggagaaagctccatgacgctggtctgggcaattagtttttggatataatccccaaagtgcagggaacaaaagcaaaagtaaacgaatgagattatctcaaactcagaaacttctgcagagcaaaggaaacaatcaacagtgtgcaaagacaacctatggaatgagagaatacatttgcaaaccatacatctgagaaggggtgaagacctaaaatatataaggaactcaacagtaagaaaacaaataatctgattaaaacctgagcaaaaagcccggcacagtggctcacacctgtactcccagcactttgggaggccaggtcagaggattgcttgaggccaggagtttgagaccagtcctggcaacatagtgagaccttgattctacaaaaaaataaaaataaattagctggggtaacaaggcagccatgggaactgataccaagggtggctagtctctctgaggggagatgagacacacaaactgcatcacctctggcagagcacatgtggaagaagtgacagtcataagaggggataagaaggaagtaattgaaaatgtaacaaattcataaaggccaaacacaggcaattgggagagctggaatcccagaaagtctcagacacaagtggaatccacattcacttgccagctttttcctgcacaccaccatctggcattcatgaggaagactggaggaatccacggaggcctgggggcatcttcgttggcaagaaaccctgattgcttcgaaaaccttgtccctttaaaaaaaaaatcattgtgtatatttgaggtttacaacatgatggtatgggttacataaagatagtaatgtggctaatgtagtgaaggaaattaacctattatatcatctcacagtgacttttgtgtgacaagaacagctaaaatctacttatttaatcaaagtgcctaatataatagcaacaatcttcatgttgtaccttagctctctagacttgttcatcctacatacctgctactttgtatccttggaccttcatctccccatttcctcctctatcctcccctgtccctgatcaccaccaatttattctctatctccctattgcttgctctttcttctatctccctattgcttgccctttctttctttctttttctctctttctttcttcttccttcctttccttctttctttccttctttctttccttttttccctttctcattctctttctttctccccccacctttctttctgattccacacataagtgagatcatacagtacttttctttctatacatgtgccatgttggtgtgctgcacccattaggtatatctcctaatgctatccctccccgctcccccgaccccacaacagtcgccggtgtgtgatgttccccttcctgtgtccatgtgttctcattgttcaattcccacctatgagtaagaacatgcaatatttggttttttgtccttgtgatagtttgctgagaatgatggtttccagcttcatccatgtccctacaaaggacatgaactcatcattttttatggctgcatagtattccatggtgtatatttgccacattttcttaatccagtctatcgttgttggacatttgggttggttccaagtctttgctattatgaatagtgccgcaataaacatatgtgtgtgtgtgtctttgtagcagcataatttataatcctttgggtatatacccagtaatgggatgggtgggtcaaatggtatttctagttctagatccctgaggaatcgccacactgacttccacaacggttaaaccagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttgtttttttcctgtaaatttgtttgagttcattgtagattctggatattagccctttgtcagatgagtagattgcaaaaattttctcccattttgtaggttgcctgtttactctgatggtggtttcttttgctgtgcagaagctcttgagtttaattagatcccatttgtcaattttggcttttgttgccattgcttttggtgttttagacatgaagtccttgcccatgcctatgtcctgaatggtattgcctaggttttcttccaggatttttatgtttttaggtctaacatttaagtctttaatccatcttgaattgatttttgtataagttgtaaggaagggatccagtttcagctttctacatatggctagccagttttcccagcaccatttattaaatagggagtcctttcctcattgcttgtttttgtcaggtttgtcaaagaccagacagttgtggatatgtggcattatttctgagggctctgttctgttccattggtctatatctctgttttggtaagagtaccatgctgttttggttactgtatccttgtagtatagtttgaagtcaggtagtgtgatgcccccagctttgttcttttggcttaggattgacttggcaatgcgggctcttttttagttccatatgaactttaaagtagttttttccaattctgtgaagaaaatcattggtagcttgatggggatggcattgaatctctaaattaccttgggcagtatggccattttcatgacattgattcttcctacccatgagcatggaatgttcttccatttgtttgtatcctcttttatttcattgagcaatggtttgtagttctccctgaagaggtccttcacgtcccttgtaagttggattcctaggtattttattctctttgaagcaactgtgaatagttcactcatgatttggctctctgtttgtctgttattgttgtataagaatgcttgtgatgtttgcacattgattttgtatcttgagactgctgaagttgcttatcagcttaaggagattttgggctgagacgatggggttttctagatatacaatcatgtcatctgcaaacagggacaatttgacttcctcttttcctaattgaataccctttatgtctttctgccgcctgattgccctggccagaacttccaacactatgttgaataggagtggtgagagagggcatccctgtcttgtgccagttttcaaagggaatgcttccagtttttgtccattcagtatgatattggctgtgggtttgtcatttggcactttttactgaacagtggataggccttttaagcagttcctagaatcaataataaagttatgttcaacttttatcttcccaggcaagagattcttgtagtaataatgttatgttaatgaagccagtggaatagtaaactcttgttcatataggcagtaagctgtgtgtgtggtttcagttctcattacttacttttagataacttatgagcgtggtaggtcatataggaaagggaaggagaggaagggggccttgattagctagttgctttttgttagtaaatgaggacatatgtgtgtgtgtgtgtgtgtgtacatatatcctattcatacataataattgtacatatttacagggtacagtgagatattttgatacacatacacaacttgtaatgatcaaatcaggataatcagcatatccaccacctcaaacatttagcatttctttgtgttggaaatgttcaaaatcctcttttatagctatttgaaaatatacaatagattattgttaactatagtcaccctacagtgctaaatagacgactagagattattcctcctatttagtcttaattttgtatccattagctaaactctacctgttcatctcccacccttcccagagtctactattctctattctgctctctacatctatgaaataaaagcttttagcttccacatatcaatgagaatattcagtatttatctttctgtgtctggcttatttcacttaatgtcctccaggctcacacatctgaagcccatacatgttgcctcaaatgatgggatttcattcttttatatgactgaatagtattccattgtgtatacatacaccaatgtaaattagattgtattttgtttacttatttcttttttattgatacattgttgtacatatttatggggtacatgtgacactttgatatatgtatacaaaggacaatgactaaatcagggtatttaggatatccatcacctcaaacatttatcatttatttgtgctgggaacatttcaaatcttcccttctagccattttgaaatatatgataatttattgttaccattagtcaccctactgtgctatcaaatagaagttattccttttacttaattgtatgtacccattaaccaacttcgcttcatcccacccaccccctgttcccagcctctggtcaccaaaattctactccattagatcaaaatttttagctcccacatatgacagacaacatgtctcgaactcctgagttaaagcgatcctcctgcctctgctttccaaagtgttgagattatacatgtgaaccaccgatcacagcttctgttttcttttaagatgtacattaaactcacatttgtgagttttctccttcagtcagaagaggaacactgactctttcatctgccccttggaggtaaatttttctttttaaataaactatgactccattgaaattcttatttcaaccaagtttatgaagcactgtctcatttaaattatcagggctatattatgcgaagatttagaagatttgaagctcctccaaccccaaatcaactgaaccttacttggtgacctgaaccctcacctctcttctgattaggctatttctgctttggttgaagatgttcatggatcctgcaaggaaaattcaatttccctaatgtcttgacatttcctataatcaccaaacctgtaactatagtggatcctactcaggataaatgtggttttaagtttatatcctgtcgtaggttattatataaaaaataactacagggatttgctaattatatctccattgtctaggtaatatacttgggagaggaaaaaaagcattgcttctcttgttttttgagtgctggccttcctccctctggctccccttgagcaagggatgaagccatttctggggtttggcaagttagccttatgggcagggcatgtggctatttgctcatgggatgtgacactccagtagggttgattttagctggagtctgggaagaccattttataagggaatctctgttgcagattcagttttaaggagagcttcttccactgtggagggcataacagggtaattggctctactccagtaagggcttcagttttaattaaatggtcatataagttttaaggtatcacgatcatgattgatattaaaatgtgaaagagttatacatcatatccagtatggcaaaaaaaaatgaagagggaaagaaaactgagagtaaggcatctggaaaagctaaatatttgcttctaaaagtaactgttttgagggacgaacagcaaatttcacaagctcatgcacagtctttgtgatgttcagatattcaggtattaaaggtatatgttaaataatgtaggtgttcctagtatgtgaaccatttcatccatactctgaaaatattagtgttcaagaatgtattccctttcaatcatgccttatattcaatatctgtgtcttgttcatattccgtgttgtgctttttccattttcctcaagaatgtttaagctactggatgctctcttcctagatatttcacaaaagaacgatctattaaatttattacatttggattacttttcctttggttaatgattcgtacctttcatttactgcctgtttccttttcccttaagtttctcttgtgactcttttttttatttctaagtattattttcttgtatcatgtaatttgctgtctattttaataggatacgcatataatgctatgactgtcctaagaatacaattcaggcttgttcaataggctcctggaaatcgtctgtaaactatcctttaatgtaaatagtcgaatggaatggttcagcagtgtggagtaaaaacatttagataatttcttccctatacgtgcagtgcttcctttaaattcagaagttcttctaattaagtcagcaatttggaaaacatgtatgaaaaatacttatgtggactactcaggacttagtacattatagactttgaactctaaatcatatcatctgatgactcaaggcagaagcctgtaatataacctctgatatggttagaggttaccatatgtgtcttcaatctaattacacacagtagctcatgaagactgacaggaggacagggagcatgcttagcacaggcatcttacaaccaccttgagcatgactgacctacatgcattctccctacttcatgggtcacaaaaacctgactgtctctatcgattttattactcagtcattcaaggcttcactgcgggaagactttaaaatgtaatcattgggtctggcgcaggaggaggttcacccctgtaatcactcccaacattttgggaggccgagacgagtgggtcacttgaggtcaggagttcgagcccagcctggccaacatggtgaaacctcgtctctactaaaaataaaaaaactggttggcatggtggcaggcacctgtaatcccaaatacacgggaggctaaggcatgagaattgcttgaatccgggaggcagaagtcgcagtgaaccgagatcggaacactgcactccatcctgggtgacagagtgagaccccatctgaaaaaaaaaatgcaatcattgtttaagagcctgagagaattcaggatttgacaaaatccaaaaacactcatgaaggtctccatacaggaaaacaagcatcaagcagagtgccttctcattttcttaggagcaatgaaatctcaactcagatattttaattggactaaagctgattgttatgatgaaaaaatcatgaaaatcagaatatctgtgtattctctccaacagaaccatagcatgcagaaatcagcactgaaatggattttaatctatttgatatgcattcactactttcaataaaagcaaaaatgggtgtaggattgatgtgatttgtccagaatctcacaaatcgtgttggagctggtactagaatctccttcagagatcagtatatttcatacaaagtggtattacaaatgcattatatatttgtgagaaacagaaattacaaagtaatctgaaaattgttagctgttggttatacttagaagtaacaaaatgctttcctatttgatggttcaatatggctttcacccaatttgtgtctgtatctgatagtgtttcggctttgcagtcaggcttctggggtctgaaccaccttacaaataaagtctgcatttgaattctgtttttaaaggggcagtaatattctctctttttattatgaaaagtgtaatattgtggaatacagaaagcacataattttgaatcttaatggataacatacctccttctggcattttaaattgctctgactttgtcagaatcttcccctggacatcaggaccatctccgcattcatccccagtctttgactgagacagctcctggagatcagcttccaggtcaggcactaaaaaataccaaggaaatcgattggagcagccagacaagaatgataaataaggaaatgatcctattcttttcctcagtgttgtgcaataaaagcctgtaggctactgtggtaataaatgtgatgcaaagatgtccccgtttgttttcctgtattatgatatcttatttttaatgacaatctgaggataagtctcagcacacctgcatttcccatactttaccattgtgtattataaacacacagctacctaggaaacctgaagatggcctcgtggatagcattttaatcataacttaaatgtaattttctgaaggattagatcaatgtattggtgagcctatgacaaatcctatagtcttgacactcatctcctgttgaggtatcttgaaaatgttgttgttaaccttaattaaagtaattattaggttgaaaggccctatatgtgactttccatacatgaatgtcattaagaaaaaatacaaaatataacagcaaaatcactgtcttccagtgagagtatgggaactgaagtgcaaagaaattaatgggcattgttgacagtcatattctggaaaccccttaacagggaattgctaaaataatccatggcccaaattctgtctctgattagtctgaaaatgctatctgttgaggaaacagtttctgtttcatgataatcttatcgtacttgaagttttctaattataaaaatattagaacaacttttaaaagccccttcaaaatcctacaaacacagttacctgtatgccattgtcctgaattatccagcttttactaaacatatggtcaaaaatataaatcaaaggaaacagtggctgtcatccattggcctcttttctggagttgctatcttgcttcactgaactgcgttttgccctgagccaataccaaattaccttatagtacagacacatttaagtattaagcatttttaagcaaaatcattcacattttctaaaacagaaggcgggaagaatgcaaaccttgaaacaaaatatgaattccttctccatgagtcgtgttcttggtaagtctcaacctctgattctcagttttcttatttatttttttatttttatttttatttttcaagacggagtctcgctgtgtcaccgaggttggagtgcggtggtgcaatcttggctcactgcaaccaatgccacccgggctcaagcaactcttctgctgcagcctgcttagcagctgggattatgagtgtgtgccaccatgcccagctaatttttgtatttttcgtagagacagggtttcactatgttggccaggctggtctcgaactcctgacctcaagtgatccacccgcctcggcctcccaaagcacagggattacaggcatgagccaccacaccgggcctcagttttatttataaaatgaggttaacatccctttgcaaatgggctttattcagggtattataaggtagggcgacttggcactccacatgctattaaagggtgcttaaaacactgtgaacaccatggctgagaagatctcactgcaacatcctaagaatatcaagttaaactagtgaaataatgtacatttttatacaaccaattaaatggtttcatctgatttaggaaggactgtattttcaagcccacaaaatgcatctcgaagaaaaagagaagattaatcatatccagggactgcaggaagctgcaaactatacccgtcacgtttccagccaaccctcagcaaatgtttgagatcctttcctagtgttttctttcctcctcttactggtcatggcataaggcatgatgcacacataggtctcctcccccccatagacattctttctttcccttcccaccaccttgaatctcagctgcaccctgatcttcttctgtcttctgaccaggtgtacgatcccaactttaagctggtggttcttcttgttgaggctctggcacactgggctcctgggaaaagagggttttgtgtgtgcgcgtgcagataaaaaatttttcttatcaatgcatgtcaataatacgaatatacagattacatagatacttctgatcatatgcatgtttaaagacatgctgcaacactagctatgtgctagtgtaatgagctatgaataagcatgaggaggaaatcactagtcaaatctggggaacacaaattcccacatccaggaaaaaccagtatgtagtcctcttgggttactgtttccttcatgagatgccgcaatggttttttgtcaacatgggagacctttatcattgcatctatactaattcaacaacactatcacacaaaaaaaattctgctaatagaaaacatcaaatgttaagtcactcacaagcataggcccaatcagctgagcaagtcgtaaacatcgtcttggtctatatcatcttcctcgccaactcatatttcagtctgcaaacagaatagtgtgcactttgggaggccgaggtgggtggatcacctgaggtcaggagttcaaggccagcttggccaaaatggtgaaacatcgtctctactaacaatacaaaaacttagctgggcatggtgcgggtacttgcaatcccagctaatcaggaggctgaggcaggagaatcgatagaacccaggggcaaatgttgcagccagccgagatcacgccattgcactccagcctgggcaacaagagcaagactccctctcaaaaaaaccaaaccaaaccatagcaaatcaaaacaaaacaaaaatcagaatactgtgattggaaaaatggggtacatgtgcaggatgtgcagccatcagatggctagattttactgtttcacactgtattagttagggatctgtaaaggacagaactgatggatagatgtgtatgtgcagcagggtttgttaaggagtattaacttacacaatcacaaggcgaagtcccaaaataggctgtctgcaagctgaggagcaaaaaaggcagtctgagttccaaaacctcaaacgtattgaagccagcattgcagcctttagtctgtggctgaaggcccgagatcccctagcagatcactggtgtaaattcaagagtccaaaagcagaagaacctggagtctgatgttcgaagacaggaagcatgcagcacgggagaagttggaggctggaagactcagcaagtctagttttccatgttcttctgcttagtttattctagtgctgctggcaactgattagatggtgcccacccagattgagggtgggtctacctctcccagtccactgactcaaatgttaatctcctttggcaacaacctctcagacacacccagaaacaatactttgcaccctttgatccaatcaagttgacacttaatattaaacatcacctgcagacctggactttaatgattcctgagtggcctcactccagcttcaaagggcaggcttgaatttcttgccaaatttgaacttcccactgccattcctgtgggccataactccggacctgctggatgacttcaaaggatcataattgcgttggtattgggaaagttgtgaaggagcccttgtgacaaacaggaagcagcagacagtatgaaagacactgcagagacaagaagcgttgcctgatacatgaccctagcaactctctagctgctaagggaggaaacagagctgggaccaacacagccagtctacctgtgagagggctcaatttcccacatgaccagagcttcccatcctccatgcatgggaatctatgaccaaacatagatttccacaggatggtgggtgggtgggacaaagtctacagattctgagcagctggcaagtttcagggtaccagagtaaacactgtcacgtgacctcagattgcttggtggttgaggccaaattatttactacctaccattttcagtgtagctctcccacttgcctcataaaatggagcaccataagggaatggaggtcacacagggacctccctgtgaatgcatgcaatgcatgacattcagctatgctgcagcccaagcaaagcctccacatgatatcaagaggacaagaggtcacatgtattttctgttccttttgcctgtgagttcccatctgtccaagtaagacttcacctgtgcaaaacagacgctgatatctgcagatgaagcacatatttcatcagtaattgtatattttgtagtagcctttgtggcccataacaaagatgatatttttgtctaaaaacactgaattgcaaaggaggtggacaaaattgggttctcatgcatatttgcatatattctatagcaacatttatcaaccatgggggatgttctctgaaaagctgtaatcatttctaaactggtttttaatccatagtgggttgtaagattaatgttgtcagccacaaacagcattttaaagaatggagataaaatatattactaaatagcgttcactgcatatagaatatacaaatacactacacatccccatgtacaaacgtatatttatttgcctagttgactatatataaactgtgtatttctcacacattgtcataaaagagtttgaacgtcactactttagtggttattagaaaaaatgtttacaggccatttctttagccatctgtgaagatgatggattaagatttgctaagaataagttcactgttgtctgtggctttctacataatgcttgaaatggcactcagtgatgcttaaactggtcagttttactgtgggcatttgaccctcagcaaactcatttgtgaactcatgagctggtgagaaggaaggctgatgagttgtggggctttacttcctaccatgtctttctgcagctgcaggtgtgaccatgtgtgtgcttctgcactcgtctgacagtgctttgatatgttcccttttatttgcccctttattattgactgtgtcttatagttcctattatgtacttcattagcatccagtgacagcgacatctgtggtattcagtgttgatccaatttacacaaattttaaaaatattttcaagcatgaatattttttcttaccaactttccttaagtacttccaggagtcaaatgcaattcaatattagtagttgatgttagaccatactggggtataatcctggaaaattactgataatactaattgttgttacgcctcagcttttatgtcaccataatgcttagataaatggcacaatgaccaacacatggaaagaaggattctgaaatattgacattttttatttccaaaatttactttaagctcaggggtacatgtgcaggatgtgcaggtttcttacataggtaaatatgtgccactgtgatttactgcacacatcatcacatcaccctggcattaagcccagcatccacgagctactctacctgaccctctccctcctcccacccccgcagtccagtaggctcagtgtgtgatgcttctcccatgtgtccatgtgttttcatcatttacctcccacttataagtgagaacatccggtatttggttttctgttcctgcattagtttgctaaggataatggctgccaccaccatccatgtccctgccaaggacatgatctcatttttttatggctgcatggtattccatggtgtatatgtaccacattttcttgattcagtttatcattgatgggaaggacatctcaaataccacaaagacacttggtccttgttgtgggaaatatcggactgtggtggggcagacagacaaacagaacagcagtagaagagcaaaggagaaacacagggaagggaaccagaggaataaaaaacaatatattggccatgagacaggggaaaacaacacaatattttaaaaaggtaatctttctcctttgcctttgccacttttctgaaaatcaacttattaggttttgtgagtctattgctggctctattttgatttgttgacttttctccaataccacactgtcttgaatactggagaagtaacacaattgccatatggggctggatgattaagaatcataatcaacaacttcatgcaatgcttcctaactcaaggcagcaccctcacctcagctgaggatcccatgcctcccaccttctcaggggctccgctcctgcactgatctctcttctctcctgaaccatcaacggctccttctatactggatcaatccccaagccaagggggaagtcaccttcttccaatgcactgataacataatcaatcaataaatataatagaattaatgtgaatcttgacctcctgtagggtgaattccccaaagttaaacttcagaattgttttggatattctgattcattttcctttgtagataattttgaaaatggactccagtgaagtgtgttgcataagttcatgcagttttcctttgcagggcaggaattaaatgtgttcgtagctagagaaggacatgggggaagagggtgagttttcccttagcttggggaatgatccaatgtagagggagcagttgatggttctggagagaggagtgatcactgtaggagcaaagcccatgacaaggtgggaggcatggtatactgacctgaggtgagggggctggcttcagttaggagtattgtatgcagaagggcagcagagaatgtccatgaatcactgaaggtgagggtggccttgggggtccctgacacagtgtcagcaaccgtgtgattcaccagcaggaccctgactcactacaacatggtgaaactttctttgagtaagggaagagcgaaggggtagagatgaggaagctgtcactcctgggagactatggatttccccatagtatgaagcagcagctgagctgttgtctattatgaaaaatacttgtactcacaacattcacaataatccctccaactgcaagggaactggctcactggatccctcaactgctgttctgtgcatgataatatatggggggaaagcgcagtctttaatttttgttttctcctgcaggcaggtagagactggatacaattgttgccaatgaactttcagtaggccaaaaatcctgaaggtttgaattgttctttcctctaagtgggagggaaaaaatcagtttcctgggctaaagcaaagccttagataaaacttaagtcttagataaaggaaaaaaagtgagaaaaaaagaccactggcagtggctcacacctgtaatcccagtattttgagaagctgagggaggagaatcacttgaagccaggagttcaagaccagcctgggcaacatagtgagacccctgctctacacaatttttaaaattagctgggtatcatggcacatgtctgtagtcccatctactcaggaaggtaacacaggaggattgcttgagcctaggactcctaggttgtggtgagctctaagtcctccagtgtattccagcctggatgacagagagaaaccctgtctcaaaaagggagtggggtgtgtgaagacacatttcagccttgtcttcagctggactgccactgctgcagcctcctcccaacatttgaggcaggatttctcttggccatggaatcataactctgtgaatgctgagttcagtgctagggttttgatggaaattacaatgagataaaaaaaaaggtacagttgtaaaatgtctttgtgttttgtggctattacatctggatgtgtgatactgacggagagggtccagcagtttgactacttaatgcagttgccacaagtgaggaattcatcttttctacacttctcactggataagggatagagacaaaagggatggatgttatgtaaactgatttttaaaatttttatgaattcaggatttcatcctgtccatttcttaaatatgatgaatcttttcactaagtttatatcataatgtgtttttctgaagatgtttcgtcccttctgcttacaacccttccagaaaaaaaaaggtctggaggacgaaatgggatgattaaagagataaaaacttttcatcacaggatacaacatggtgattctgtaatagtggagaaaacagaaaacctggcacatgaggagaggcaagggagggaaggaggacatcggttgtctctgtttttcaaaactattcctgcacactctccacttttcctcagaaatacttcccatgagggctttccaagccactgtgagccattgttaaaaccacattcattggtgagccggtgattaccttacaggtattcaaggaaatcagctaccagtcaagaggtataaaagtgcaataacacaaccttaaaaaaaagtacaggtgtgaattgattgtctacagcatgtataaaaattggcaggcatgggaggatcacttgaggccatgtgtttgaaagcagcctgagcaactcagtgacaccccgcatctaaaatataataattattaaatacgttaggagggcgtggtggcggccaactgcagtcccagctacaggggaggttgctgtgtgaggaggattgcttgagcccaagagatggaggctgcagtgagccatggtcatgccactgccctccaccctggacaacagaaaaacaccctgagaaaacagtatgtgtaaatatagacataaaattctttatttctgtcacaaaaggtctttctgagacacaccctccactaagggtgacatgggactctctgttctcaatgtttctggatgcctgagaatggctgggcaagagacaaaaaaaatttaaaaaatctctcatgtccctttcttcctactacaaactacctgggataagggtgtggggatagcaggaaaaccctggccggccctgcatgtgcctgactcagtgtgcatgccccttgctgcacaaggcgtagtggctcacatctgtaatcccagcactttgggaggccaaggtgggtggatcacctgagttcaggagttcgagacgagcctgggcaacatggcgaaaccccgtctctactaaaaatacaaaaattagccgggcgtggtggcacatgcctgcaatcccagctactcgggaggctgaggcagagaaactgcttgaatccaggaggtggaggttgcggtgagccgggactgcaccattgcactccagcctgggcaaaaagaatgaaactctgtgtcaataaataaataaataaataaataaataaataaataacagaaaaatgaggctcagagattgagacttaccaagaacacttgactcatggaggaggaattcatattttgttccaaggtttgcattcttcccaccatccatgtcagaaaatgtgaatgattttgcttaaaaatgcttaatactcaaatatgtctgcactgtaaggtactcagcattgactcaggacaaaacgcagttcagtgaagtaggatagcgtctccagaaaagaggccaataaatgacagccactgtttcctctgatgcctatttttgacagtatgtttggtaaaaggtggataattcaggacactggaatacagataactatatcagtaggactttgaaggggcttttaaaagttgtttcaatatttttataattagaaaactccaagtacaataagattatcgtgaaacagaaattgtttcctcaacgaatagatagcactttcgaactaaagatagacagaatttgggccatggattattttagcaattcactgttaaggggtttccagaatatgactgtcaacaatgcccattaatttctctgcacttcagttcccgtactctcattggaagacagtggttttgctgttgtatcaggtactttttcttaatgacatatagggcctttggacctaaacattaattaagtttaaccccaacactttcagggtacctgaacagggaattagtgtcaggactataagatttgtcataagcagaccagtacattgatctaatcattcagaacattatatttaaggtatgattaaaatgctatccacggggcagtcttcagatttcctaggtagctgagatacttcagatttcctaggtagctgagtgtttataacacacaatgttaaaaagtatgggaaatgtaggtgtggtgtgatttatcctcagattgttagttaagatatcataatacaggaaaacaaacggggacatctttgcatcacatttattaccacagtagcctacaggcttttattgcatcacactgaggaaaagaataggatcatttccttatttatcattctggtttggctgctccagtcgatatccttggtattttttagtacctgacctggaagctgatctccagaagctgtctcagtcaaagactggggatgaatgtggagttggccctggtgtccagggggaagattctgacaaaatgagagcaatttaaaatgccagaaggaggtatgttatccattaagattcaaaattacgtgctttctgtattccataatattacacttttgataatgaaaagagagaacattactgcccctttaaaaacagagtccaaatgcagactttctcgggaaggtagtcgagaccccagaagcctgactgcaaaactgaaagactatcagatacagacacaaactgggtcaaagccatattgaatcatcaaatagaagcgggggctcacgcctgtcatcctagcactttgggaggccgaggcgggtggataatttgaggtcaggagttcgagaccagccagggcaaatggtgaaacccagtctctactaaaaatacaaaaaattagccgggcttcatggcaggcacctgtaatcccatctactcgggatggtgaggcagaggaactgcttgaacccaggaggtggaggttgcagtgagccgagatcatgccactgtactccagcctgggcaacagagtgaaactccgatctcggggggaaaaaaaagaaaggaaaagaaaaaagaaaagaaaagaaaagaaaagaaaagcattttcttacttctgagtataaccaacagctaaaaatttgtagattattttctactttctgcttttcacaaatacataatacatttgtaataccacttcgtatgaaatatgctgaccctgaagaagattctaataccagctctaagataatttgtgagattctggacaaaacacataaatcctgcaccggtttttgcttttattgaaagtagtgaatgcacatcagatagattaaaatcatttcattgctgatttctgcatgtttcggttctgttggagaaaatacaaagataatttcattttcgtgatttgtttatcataaccatcagcttcagtccaattataatatccgagttgagatttcattgctcctaagtaaatgagctggcactctacttgatgtttgttttcctgtatggagaccttcatgagtgttcttggattttgtcaaatcctgaattctctcaggctcttaaacaatgattgctttttttttttcagtaggggtctcactctgtcgcccaggctggagtgcagtggtctgatctcggttcactgtgatctccacctcccggtttcaagggattctcatgcctcagactcctgtgtagctgggaatacaggtgtgtgccaccacgccggactaatttttgtatttctagtagagacagagtttcaccatgttggccaggctgggctcgaactcctgatctcaagtgatccacctgcctcagcctcccaaagtgctgggattataggcatgagccacctcccttgctggacccagtgattgcattttaaagtcttcccgcagtgagaccttgaatgactgaataataaaatggaaagagacagtcaagtttttgtgacccaagaagtagggagcatgcatgtaggtcagtgatgctcaaggtgtttgtaagatgcctgggctaagcatgctccctgccctcctgtcagtcttcatgagctactgtgtataattagattgaagacacatatggtaacctctaaccatatcagaggttatatattacaggtttctgccttgagtcatcagaagatacgatttaaagttcaaagactataacatactaagtcctgagtagtccacgtaagtatcttttacacatgttttccaaattgctgacttaattagaagaacttctgaatttaaaggaagcactgcatgtttaggggagaaattacctaaatgtttttactccacacttctgaaccactccattaggctattaacattaaaagattgttttcagatgatttccaggaggctactgaacaagcctcagttgtattcttaggacagtcatagcattaaatgtatatcttattaaaatagatagcaaattccatgatacaagaaaataatattaagaaagagcaaaataataagagtcacagaataaacttaagggaaaaaggcagtaaatgaaaggtatgcatcattaacaaaaggaaaactaatttgatattaataaatttaatagaatgttcttttgagaaatagctaggaagagcatccagtagattaaacaatcttgaagaaaatggaaaaggcacaacacagaatatgaacaagacacagatattgaatgtagggcataattgaaagggaatacattcttgaacactaatgttttcagagtgtggatgatatggttgatatgctcagaatgcctacactatttaatatatccctgaaatacctgaatatctgaacatcacaaagactgtggaaggacgtgaaatttgccagttgtacctcaaaacacagtcaccttttttttttttttttgagatggagtctctctctgttgcccaggctgcagtgcagtggcacaatcttggctcactgcaagccccgcctcccgggttcatgccattctcctgcctcagcctcccgagcaactgggactacaggcaccagccaccacgcctggctaattttttgtatttttagtagagacggggtttcaccgtgttagccaggatggtcttgatctcttgacctggtgatctgcctgcctcggcctcccaaagtgctgggattacaggcgtgagccactgcgcccagccaaaaacagtcacttttagaagcaaatatttagctttccagatgtgttactctccgattttgtttccctctccatttctttttctttgccacattgcttatgatgtataactgtttcacgttttaatgtcaataatgacagtgatatcttaaaacttatattaccatttaattaattatacaaatgggaatactttccggtgaaaaatgtatcattattcatattgacataatgactataggtgaaaactggatgcaaatggttagtgtatgtcaaaaaaggactaagaagggtaaactagcccaaagcaatattattgcacttctgcacaatagacaaaaaacaaatgcaatactggaccttctattcacttcacttacgtatttcctaatgtatcataactgttttcagttacattatggcaaaacatacttctcagactatttgcaggagcctattggacatccaggtgatagtttcaagccaaaacattaaattatatatttttcacaaattccttcggttgcttaggttttttgtgttttagttgcattttgagtaaaactctacacaatgtttgctatctactttaagccccttttaataggttcacttgatttaatgtgttctggtctcagactgtcttttggtttccttctagcaccaaaagcggggtgtgtttaaaaaatgttgtttaatgtgtatgcttggaggtgttatgttcaaagtctctacagaggtctagtggaatgttagccatagggtgactcttacttaggcttctggtttttgtccaatgtataaaactaaaattttggtgtcctttgtatacctttaatttcatctgaatacagttctgctagtaatgttccttcctgttgtgtttctattgcaggggaagggcaaccacagctttaaacaaaggcaagctgaaagaatgcaaactggatttatccgagatatttgacttttaaaaatctcaataaagatttccagttttctccaaataagtatcacacatcttttgttcatttattctcgcatattagaccctattgtaaattttggccgggtggagtggctcatgcctgtaatccaagcacattgggatgctgaggcaaggggattgcttgagcttgggagagtgagacatgcctgggcaacatggcaaaaccccctctctacaaaaataaatgaatgaatgcatgaatgtatgcatgtatgtttgtaggtgtagttccagctactctggaggctgagatgggaggatcccttgagtctaggaggtcgaggatgcaggtagtcatgttcacaccactgcaactccagcctgggcgaatgcgactctgtctgaataaaatatagtatcatttttgcaactttgcattctgattgagctggtatacacatgtgtgatattgtgaaatatatatatttggtcctggaccctgcttactgtcatacagctcctacaggttttagaatcgcctcatagcgacgtctttttgtatgctagtgagttgactgatggctggcagctcctaggtagctctaggatgggagcttagagggttcgcactttcagctgcatccccaaccttcaggacagggagaggggctgaaggttaagttgattgccaatggcgggccaacagtttaatcaatcatgcctttataatgaaaacctccatcaaaacccaaaaggacagggttcatagagcttctgcctagcggaacacatggagggtagcatgcccgtagagggcatggaagccccctgcctcttccttcattccttcccctgtgtatctctgtatctgcatccttcgttaggatatcccatttgccacaagatatgtgagaattccctagactatagagctggatgaaagaactagcgcctaggcagaagaaaaaggaaagcgactaggtcaatttgctgaagcaaaattacttggatcctacctacactgtctccttacaggcaatggcatggcatagccttgggtgtccatcctgcctctcaaacactggccttgtgatgttgggcaagatacttacatcctgtgggactgtttccccatttccaaagtagaaattagaatatttagactaaatacttgctttgaagaataaatgaaataacataagatgcaggcattacattgcagataaatttactagttatctttccttaatccctttaaaatttcacattttttttacaactacatctctagtatgtgataagtgctttggaatttcaagtaggaatattagtctaccttttaaaatgcatttgacttcagaaactgatttgatgtaaatatgtaaattaaatagcagttgtagctggtatcagacatggcattgcttttgaagttgatttgtaaataaccgaggtgtgacaaggccaacactaagtcagtagtacgtgctgaaaacttgtttggtgtgtgtgaagccatgaagaataagtctactccagtcagtcaacaccacacaactcaatatcatcgtgtgtcaagagctcaggcagtccctaagcagccctgtggtggctaacagggacacaaggatcgccagtgcggttgttattttgtcttgtcatatattcatagatttggtgggtaagaagacaatgaggccaaatggatcgaaatggttgattacttgcagacggaacaaaagcaagatcggcattgtgtcaacactgtgtcgctactcccacagtactacactgaattggagatactcagtaacagcacagatggtgggtctctctgcctgtgaggagcccacagtcaaaacctaaggccaattttgaaaccacactgaatcctgaacccaaacttacatctgaccgagctgtgaccattgggcagcaggggtgacccagctgctgaacatcccacatagaacacctagggatgtcattcacacttgtgaataggaagaactagtgtcaatgactactctgaactgactgcctgctgatagttccactaaatgaaagatgcaaatcaattgtttggactggacaaagaaccctagagggaaaggtccctcagtgggaggccacattgggggccttggccagctcctgcctgatgactgtatgtcctgctgggggtgccttaacaagggtaaactcttggtgtccaggggtatcacctgtgccctctgggattgttcttacctgtatgccctgactatcccaccactgcctcatccctggaaggcattcacatcagcttcggcttcctggccagagttgttatgaccctgaaatgctggcttgggttggacaaaaatggataatacagaatcttagttaggaagtcacctgcctttgtcagataggccttcatcattattaggatttgtataagatggctatgatgggaaagctgatgtgtcaactttgctacgccacaatgcatgagaaatgttcactttgaccagggtagatgctctgtgaagggttttctttaggagaactaacatttaaatgagcagactttcagtaaacccaattgccctctccagtgtgggtgggcctcatccagttccttgaaggccttcagagaagaagactgcggttctccacaagatgaagaaattctgcctccacactgcccctggatttgagctctcatatcatctcttccccgggtctccagcctgacatcctgctctgcgagatttggacttcccggtcacaacagctgcatgagctaggtcttcaaactcaatctttctctctctctctctactcactcacataaatacttgggtgcacagcccaccccacgacacacacacacacacacacacacacacacacacacacagaagaaccctaaccaataggctgcttatatttggggcccttaaagtgcataactgagatcgatactgcaggttgatctcactctgctgcatggctccaaacgcagaggcctgtggtgttcccctcccatgcactgacatccatgctgctcgtcactgcgactcagggtttggtcatctaaccatgtagaggtcactacaattctacaagtgttctctgccctccttctgcatgtgaggtcctctgttccatcctgagggcacagagatctactgggtatgtttccatccttccaagaaggactttggagcctggtgagggagatacacctgcaacagcggtaacagcaacgggcatagccagtgtgttcaccaactcatgagagatcacactaccaacatctcccacataaatttccccatcaacaaagagcttatcatggaaatgatcgtgttcgtaggtatgttggattccccttattctattttccccaggaatgcacagatacaaagaaaactgatgctggaatgttgtgttggagtgcaatctaagaatggaatgccctgcagtgatgtgatttctgaagcagtcaataagtctttataagttcttagatgaagcaacatacaagtctccctcagtttacagggaagtgacatgtatggaaaatccagtttatggaagactttggaaaaagatgtttgcctccctgtaacactcattccccaaatgccagcagcccctaccaatcattccaacaaccacagctgcactcagaaaagtccaaaatggcccagtaggtaacgatattctggctataagccacaagtttatgattgaaaagaagtatcctcaaacttcttgtttacataaaaagagtagggatattgtggtcggtacaaaggaaataacagggcaccaaggaggaggacacaatgtccctgggaggggttacaggcaccttcctcctctgtcttgctttgctttctgtgataagaaagtggttcagggataggcgtggtggctcccgccagcttgggggacatagggagaccccttttctactaaaaattttgaaaaacagccaggcatggtggagcatgcctgtagtctcagctacttgggaggctgagatggaagcatcgcttgagcgtgggagtgagccatgatttctccactgtaatccaggctgagcaacagagtgggaccccatctcaaataaaacagaaataaaagaaagtgtctcagggccagctgcgatgggtggtgaagcttcatttcaaaggtcaatcactgccatgaacattaatactcagatggttctgtggtagtcatagctctgagatcctgggactgatgtccttcttgatgaggatagccctctccaggctgggacacaagagcaaggtgccaggctaggtcatcaggctaccagggacagctgtctgctgtgggatcacagatgagatcaggagaaggacagctgaagggaggagaagggagacaacctcctcagaggaggtgcaggtgtctgttactgaagggaaggcatttgccctaagtcctgacattgctctaggctcccatggatggacacgatggtaccagaaagatccaaggctggtgggaggagcacgatagcttccatcacctcccatcttatgtgttcactggtcccttagggaagtccatgcaattttggaatctaaagggttattttctggcattccctccattcaccacccacaaagagaagggatttgagataaactgaggtcttcagggagaaaggccagatggagttgtgaggccttctcaaaagtccctctgccctacccttatggtgagtctcacactgcattcatcatgtcttgtgttcctgtgtgctctgaggtctctcttctcaacctcatgtctgtcttgggaagagtgggtatattgcagacagttttgcaacctaagggatttaatcagttttctgaaacttccctagcctgggcagtaaattcccagatcctagggcaccattccgaccacactacatgagactcactgggtgtgaatcatggaatcttcacttttaaaggatcctggattccaactttcatggaaacttgtctgagaactagtagagcaggggagtagtctcctttcccagctgcacagcttctttctcctttgtgaaggtatagaagggacaggtttttttgtgttctctgatgtacaaacccaagatcttcaggtgaagacatgctgccgttatggtaatgacacactcagggcactgtctccaaatcatacccaggccaatcctttcaagtctccatctcttaactatttctgaagaaatcaaatgtctcttgcctgtgcagtcccatgctataaaattctaaatattttgctatagcctttggctcttacccttcagatcttacccttgcacaaatatgcagcacaatagagttttccatgatgcctctgacctgtgcctccaccactcagtgctggtgacactgagaaagttacttaacatctctgtgactcctttctccaatagtaccatagaaatactactagtaaatttatgtagttcttggggcagtttagagcactgagtgtgtgaagaaaacatgtacggttgtcaggaaagtccctggcatatggtcaatttccaatcaattctagctgttactgttttgctgtttatattgttgctgttcccacatttccctgggagcatgttccagagatacaatgtcacaactacctttgaccccttccatgatcttttgattatcacttcatttcttcagggactcaaggactgagtctgtgggggcagggtgaggccatatttttatgagcataataaatattcagctctccttacagggtattgtggagcctaaatgtaatgctgggatttcatcatcatgagcttgtatgaaaaatttaaatggaaatttctctaggaaatcagaagtctaatgacctcttcatgtgatttgtataatgcttggaaaagtaattagtgactggataaggatagcatgtaaatatataaatattaaaaattttatgaattttctatttcatagtttgtgtgttttgtatcccatctatcgttgttttacatgttgccacagattctcctacattttcttctagaagtgtgataagttctatgatgcattttgaattaacttttgtatatggtgtgagacaaaggttcaggttcacttgtttgcatgtcaatgtccaattgttccaccatcattctctgaatacagcatcctttcccactaaattatcttgggaccttatggaaaaaaattaacgagaatatataggtctagctttggcccttatttctttccttatgccaatatcacagtgtcctgattaccacagttatgaaatacatcttgaaaacaggtaacgattcctccaatattctttgttctttataaaattgttagactattccagtccctttgcttttccatataaactttgaattcagcttatcaatttgtagaaacaaaaagttgcatggattttgattgtggttacattgaatgtgtagttcatttgggagaaactgacatgttcacaatcttgagtattgcaatccattaacgtggtatacctctccactgatttcagcctgctttaatatttcacagcaatgttttttaggcttctgagtacaggttttgcacatattttgttaaatgttaccactaaacatttcatgagattttgccgctatattaagtggcattgattttaaattttcaatagtttgttgctgcgaaagtcaaacttctcttgtacatattaccatgctaaactcacatatacatgtataaatatattcaagtcatggggtgaatctcatttggctatgatgttgtaaatttttaatatattcctagttttgacctgctattattatagcataaacataaatctatgcttttatagacatgagttatattagtctgtcatgttgttttttcatgatgtttgtctggttttgataccaggttgatgtggactctgtaaaatgttttgaaaagtgtgatctcttttcaattataaagagtttgtgtagaaacaacattatttctttcacaaatgttttgcaggattatccagtgaagtcaccagaaacgtgaaatttatttgagaaaaaatctttatttcatttctttgtttctgatgtatttcttcctttttgatgtataatgtaaaatgtataatcttttgcaaacactctttttaatgttctggcttgaatctatggtctgtatgccaaatgggctcctggaaatagtctctcttggaagaaaatggttaatgtcaccttaggaactgcatcagggaagtgaatagaaaggccagcattgcatttatttttactctattgtgcagaagggcaaaaatatttatttgggctcgtttaccctactgtggtttttaaggtacagtaaccgtttgtacccagttttcttctaccgtgatgtcaacatgaatgatgcctctttttacacttgaaagtattcccatttgtataattaaatataaggtcacattactcttaagctatcactatcagttttgtcatcaatgtgtgacagcattatgaactgtgccacacacgaaaaaatggagggatatggaaatggaaaacaatagtaagacatctgaaaaagtcaaaatcagtttctgaaagtaaatgggatgccttccgagcttatcaaccatttcattcatgctctgaaaatattagagttcaagattttattcactttcaataatgccctatattaaatcaccctgtcttgttcatattccatgtcgtgctttttccattttctgcaagatggtgtaaactactgaatactctattcatacctatttttcaaaagaccattcttttaaatgcattacatttgaattattttttcttttactgatgatttgtaactgtcttttattcattacctctttctttttcctttaagtttattctgtggctcttttattattatttcatagtattattttcttttatcatgtaatcagctatttattttaagaagatttgcatttaaagctatgatctcccaaaaaataaaacagagtcttgttcaataggctgctggaaatcgtccgagaactatcttttaacgtaaacagtctaatggaatggttcagcagaggagagtaaaaacatttaggtaatttctcccttaaacatggagtgtttcttttaacttcaagaggtattctaattaacagtcaccaatttggaaaatatgtgtaaaatatatttatgtcaaccactcaggaattagcacattactgttattgtactttaaaccctgtcatctaatgtctcaaggcagaaacctgtaatgtgtaatgtatggtatggttagaggtgactctactatatgagtctttaatctaattacacgaagtagctcatgaagactgactgacaagagggcagggagcatgcttagcagaagcatcttacacccaccttaagcatcactgacctacatgcattctccctgctatactggccacagaaatctgatgatctcttgccattttatcattcagtcattcaaggcttcactgcgggaaggctttaaaatgcagttattctttaagagccagagaattcctttggcaacaacctctcagacacacccaggaacaatactttgcaccctttgatccaatcaagttgacacttaatattaaacatcacctgcagacctggactttaatgattcctgagtggcctcactccagcttcaaagggcaggcttgaatttcttgccaaatttgaacttcctgctgccattcctgtggactgtaactccggacctgctgaatgagttcaaaggatcattatagtattgggattgggaaagttgtgaaggagcccttgtgacaaacaggaagcagcagaaagtatgaaagacactgtagagacaagaggagttgcttgatacatgaccctagcaactctctagctgctaagggaggaaacagagctgggaccaacacagccagtctacctgtgagagggctcaatttcccacatgaccagagcttcccatcctccatgcatgggaatctacgaccaaacttagatttccacaggatggtgggggggtgggacaaagtctacagattctgagcagctggcaagtttcagggtaccagagtaaacactgtcacgtgacctcagattgcttggtggttgaggccaaattatttactacctaacattttcagtgtagctctcccacttgcctcataaaatggagcaccataagggaatggaggtccctgtgcattcacagggaggtctccgtgaatgcatgcaatgcatgacattcagctatgctgcagcccaagcaaagcctcctcatgataccaacagaagaggtcacatgtactttctgtcccctttgcctgtgagttcccatctgtccaactaagacttcacctgtgcaaaacagacactgatatctgcagatgaaacacatatttcatcagtaattgtatattttgtagtggcttttgtggcccatatcaaagatgacatttttgtctaaaagcactgaattgctaaggagggcgacaaaattgggttctaatgtgtttttgcatttattctatagcaacatttaccaaccatccaagatgttctctgaaaaggctttaattatttcttttttttattattatactttaagttctggggtacatgtgcacattgtgcaggttagttacatatgtatacatgtgccatctaaactagtttttagtccatgttcgatcataagattaatgttgtcagccaaaaacagcattttaaagaacagcattttaaaaaatggaggtaaaataaattactaaatagcgttcactgcatagagaatatacaaatacactgcacattcctatacacatacatatatttatttgcctagtcaactatatataaactgtgtatttatcacacattgtcataaaagagtttgaacgtcactacttcaggggttatcagacaaaacgtttacaggccacttccatagccatctgtgaagatgatggattaagacatgctcagaataagttcactgttgtctgtagctttctacataatgcttgaaatagcactcagtgatgtttaaattgtcagtttgactgcagggtgtgttcatgtgtgtgttcctgcactcatctgatgatgctttgatatgtctccttttatttactcctttattatttactgggtcttatggttactattgagagaagagagagatcctctcatattgttttatattgttttatattcagtatcttttttaagaaaaaacaacaaggaagtaaaaccaaagacaggcagccccgcgccaggcccaaaacctgacccgggcctgcctggcctaaacctagtagttaaaaatcaactcatgacttagaaaccgatgttattcatagattccagacattgtatagaagaacattgtgaaactccctgccctgttctgtttctctctgaccaccggtgcaggcagcccctgtcacatacccattgcttgctcaaatcaatcacgaccctttcatgtgaaatctttagtgttgtgagcccttaaaagggacagaaattgtgcattcggagagctcggattttaagacagtagcttgccgatgctcccagctgaataaagcccttccttctacaactcggtgtctgagaggttttgtctgcggctcgtctggctacactattatgtaattcattagcatagtgccagtgacatctgtggtactcagtgtcaatccaatttacatgaattttaaaaatgttttcaagtgtgaatactttttcttaccaactttccttaagcacttcaaggagttgaatgcaattcaatactagtagttgatgttatatcatactgagctataatcctgctaaattgctaatctactaactgttgttatgcctcagctttcatgtcaccataatgcttagataaatgacacaaagaccaaaacatagaaataaggattctgagatattgacttttttttaatttccaaattttactttaagttcaggggtacatgtgaaggatgtgcaggtttcttacacaagtaaatgtgtgccacggtgatttaccgcacacatcatcacatcacccagatattaagcccagtatccgtgagctgttcttcctgatcctctccctcctcccacccccgcactccagtacgccccagtgagtgatggttctcccatgtgtccatgtgttttcatcatttacctcccacttataagtgagaacatccggtatttggttttctgttcctgcattagtttgctaaggataatggccgccaccaccatccacctccctgccaaggacatgagctcattcatttcatggctgcatagtatttcatggctgcatagtattccatggtgcatgtgtaccacattttcttgattcggtttatcattgatgagatggacatagcaaatatcacaaagacacttggtccttgctgtgggaaatatcgcactgtggtggggcagacagacaaacagaacagcagttgaagtgcaaaggagaaacacaggaaaggaaaccagaggaataaaaaacaattaatgtagtggccacgaggcaggagaaaataacacaatttttaaaagataatctttgtccattgcctttgcctcttttctgaaagtcaacttattaggtttgtgagtctattgctagactctattttgatctgtagattttcccccaatatcacactgtcctgaatactggagaagtaacataattgccatatggggctggatgattaaaaatcataatcaatagcttcattcaatgctcctaactcaaggcagcaccctcacctcagctgaggatcccatgcctcccaccttttcaggagttctgctcctgcactgatcattcctctcccctgaaccatcaacggctccctctatattggatcaacccccaagccaagggggatgtcaacttcttccaactcactgataacataatcaatcaataaataaaatagaattaatgtgaatcttgacattgtgtggggtgaattcccccaagttacacttcagaattgttctagatattctggttcattttcctttgtagaaaattttgaaaatggactccaatgaagtgtgttgcataagttcatgcagttttcctttgcagggcagcagacacatgtgttcgtagctacagaaggacatgggggaagaaggtgagttttcccgtagctggagaatgatccaatgtagagggagcagtcgatggttcaggagagaggagtgatcactacaggagcaaagcccatgacaaggtgggacgcatggtatactgacctgaggtgagggggctggcttcaattaggagtattgtatgcagaagggcagcagagaatgtccatgaatcactgaaggtgagggtggccttgggggtccctgacacagtgtcaacaaccgtgtgattcaccagcaggaccctgactcactacaatatggtgaaagctttctttgagtaaaggaagagtgaaggggtagagatgatgaagctgtcactcctgggagactatgcatttccccatagtatgaagcaacagccgagctgttgtctgttatgaaaaatacatgtactcccagcatttaacaataatccctccaactgcaagagaactggctcactggatccctcaaacgctgttctgcacaggataatgtatggaggaaaagtgcagcctggtgctgactttaatttttgttttctcctgcaggcaggtagagacaggacacaattgttgccaatgaactttcagtaggtcaaaaatcctgaacgtttgaattgctgtttcctccaagtgggagggaaaaaattcagtttcctgggctggagcaaagccttacataaaccttaaaacttagataaaggaaaaataagtgagaaaaaggccacgggcagtggctcacgcctgtaatcccagtattttgagaggctgagggaggagaatcacttgaagccaggagttcaagaccagcttgggcaacatagtgagacccctgctctacacaatttttaaaattacctgggcattgtggcacatgtctgtagtcccatctactcagaaacgtaaggcaggaggatcgcttgagcacagaagtcctacgctgtggtgcactataagtcgtccagtgtactccagcctgggcaaaagagagaaaccctgcctcaaaaaaggggttgcaggtttgtgaagacacattccagcctcgtcttcagccgggttgccactgctgcagccccctctcaacatttcaggcaggatctctcttggccatggtacttgcaagtgtgtgaatattgaatttagtgctaggggtttaatggaaattacaatgatataaagaaaaccgccacagttgtaaaatgcctttgcattttgtggctattaaatctggatgtgtgatatcgatggacagggtgcagcagtttgactaactaatgccactgtcacaagcaaggaactcatcttttctacacttctcaccggataagtgatagagacaaaaggattggaggttatgcaaactgagttttacaattattacaaattcaggatttcatcctgaccatttcttaaatatgatgaattttttcacgaaatttatattacaatgtgtttttctgaatatgtttagtcccttctgcctaccacccttccagaaaaaaaaaaaaaaagttttgaggaagaaacgggatgatgaaagagataaaagcgtttcatcacataatactccatgctgatttgttaacaattggagaaagcagaaaacctggcacatgaggagaagcaagggagggaaggaagacataagtagtctctgtttttcaaaactgttcctggaaactctccagttttcctcaagacatacttcccatgcaggctttcctagctgctgtgagtcaacgctgaaatcacactgactgatgagccatgatcaccttacaggttttcatggaaatcagttaccagttgacaggttcaaaggtggagtaacacaatattaaaaaagcacacaagtgtgaactgattgagtctacagcatgtataaaaagcctttataaaaattggccaagatgggaggatcacttgaggctgtgtgtttgaaggcagcctgagcaacacactgacacacctcatctaaaaaaaaaattaaatacattaggtgggcatggtggcggccatctgcactcccagctacttgggaggtttcagtgtgaggaggcttgcttgagcccagaagatggatgctgcagtgaggcgtgatcatgccactgccctccacccttcacaacagaaaaacaccctgagaaaaaggcatgtgtaaatatagacataaaattctttatttctgtcacaaaaagtctttctgagacacactccgcactaagggtgacgtgggactctctgttcccaacgtttccggatgcaggagaatggttggacaagacacacacacagacagacacacacacacaaacacagacacacacagacacacatacacacacacacacacaagcacacacacaaaagctctcgcgtccctttgtttccactacaaacaccctggaattcgggtgtggggataccaggaaaaccctggtcggccctgcctgtgcctgactcagtgtgtctgctataaagacacatgcacacgtatgtttattgcagcactattcacaatagcaaagacttggaaccaacccaaatgcccatcaatgatagactggataaagaaaatgtggctcatatacaccatggaatactatgcagccatgaaaaaggatgagttcatgtcctttgcagggacatggatgaaattggaaaccatcattctcagcaaactgacacaggaacagaaaaccaaacactccatgttctcactcataagtggtagttgaacaatgagaacacgtggacacagggaggggaacatcacacactggggcctgttgggcgatgggggtctatgggagggatagcattaggagaaatacctaatgtagatgacggcttgatgggtgcagcaaaccatcatggcacgtgtatacctgtgtaacaaacctacacgttcagcacacatatcccagaacttaaagtataatagtaattttaaaagaaagaaaatggttcacggcaaggtaaggtggctcagacgtcaaatctcagcatgttgagtcatcgaggcatgaggattccttcagccccagagttcacgaccatcctgggcaacatagggagaccccgttttacaaaaaattttaaaagcatatacccaggcatggtggagcatgcatgtaattccagctacttgtgaggctgagatggaaggattgcttgagtctgggaggtcaaggctactgtgagccatgatttctccacggcactacaggctgagcaacgcagtgagggcctgtctcaaatgagacaaaaagaaaagaaagtgtttcagggccagctgcgatgggtggtgaagcttcatttcaaaggtcagccactgccatgggacactgatgctaaggatggttctgtagtagtcatggctctgggaccctgggactgatgtccttccactcggggagggcagccctctccaggctgggacataggaggaaggggccaggctagatcatcaggctacgagggacagctgtctgctgtggaatggcagatgagatcaggagaaggacagctgaaaggaggagaggggagacgcactgctcaggcgaggggccggtctcctaaaaagggaagacattggccctaagtcgtgtcattgctctaggctcccgtggaagcacatgatggtgcaagaaggaaaccaaggctggtgggaggggaacaatagcttgcatcatgccccatcctatgtgttcagtggcccctgaaaggagcccatgccttttggggatcgaaaaggtcatttcctgacacaactccattcaccacccatgaggagcagggatttgagataaactgaggcctctggggagaaaggccagtaagagttgtgaggtcttctcataagacgcactgccttacccttatggtgattttcacactgtgttcatcatgtcctgtgtttctgtgtgctctgaggtcgctcttctcaacttcatgtctgtcctgggaagagtggatatatttcagacagtcttgctacctaagggatttaataaagtttctggaagttccctaggctgggcagtgaattcccagatcctaggacaccattgtggccacactacataagcttcactgggtgtgattcctggaatctgcacttttaacagatcttgggctctaactttcacagaagcttgtctgagaactactagagcaggggaatagtctgctttcccagctccaaagcttctttctcctttgtgaaggtatagaagggacaggtttgtagtatataaaattttaaaaatgtatgtttgttctatttcatagtttgtgctttttgcatcctgtctatctttatcttacacgatgctgcagattcccttacattttcttctacaagtgttgtaacattagctttcacatttagttctatgaagcattttgagttaacttttgtgtatggtgtgaggcaaagtttgaggttcatttgtttgcatgtcaatgtccgactgttccagcaccactcctggaataaaacatccttccccactgaattctcttggcactttatggaaaaatccatttaacttgaatatatagatctagcttcggactcttatgccttttcttctgccaatatcacagtgtcctgattagcatagttgtcaaatgcatctcgatatcaggtaatgtgagtcctccaatattcttggtcctttataaaattgttaggctattctagtccctttgctttcccatataaattttgaagtcagcttgtcattttatagcaacaagaggctgcagggatttttattggtttacactagacatatagattatttgggagtaactgacatattgacaatcttgagtcttgcaatccattaatgtggtatgtctctctatttatttcaacgtggtttcatatttttctgaaatgttttttaggcttctgagcacaggtcttgcacatattttgttaaattttaccactacagatttcacgggggggtttgctgctatattaagggatatcgactttcaattttcaattgtttgttgctggcatataaaaatagcattgacttttccatgttcatcttgtaccatgttactttgctaaactcacatggaggaaattccatttggctaggatgtaaattttttatgttgctagtttctaactccggttaattgttttttacagagtttgtgtctatgttcatgagttacattggtctgtcatgttattttctcataatgttgtctggttttgatatcaggcttgtgcttgctctgtaaaatgctttggaaagtgtggcctctcctcaattatcttgagtggagaactggtgttatttctcccagaaacgtttggcagaattatccagtgaagtcaccagaaacatgaggtttaattgagaaatatctttgttgagtttctttgttgcttttactgaatccaattcctttaattgatatacggctatatatgtcgtttatttgttttttaacgtttcatttatgtccatttttatgggtatttagtaggcacacatacttgacatgttttgatgcagcttgcaatttgaaatgaggacatgatggagattgaggtattcctcctctcaagcatttatccactgagttgcaaataatccaattatactgttcatgttattttaaaatgcacagttacactctttttttgtttgtcttttttagcacttgtccactgtttattcattggaaggaaggcccggtcctaggtagactcgacctcccccgaggaaccttggagccaaaggcaggaggcttccagaatgcttagactctgatcctccttactatcaccctgagacctgtctcaccaaagccttcttctgtccatggttttctcactggatctacaagggaatccccccacaagtctggggtccagtgtggtcactcctgatggttttcaagaaggggaaggccaggaacctagggaaatacctcatttggcccgaccacaactggccagagcaggacaaacatgccatgccatgtcaggcgcccagttacccagctggagggaaagtcagtcctgagagggtggaaggggccagtcacaaatcccggatagatagtgacctgggctccacaggtgagctgggctctgatggctttccctgcctttggaaacaaggaggagaagttttttgcagaaaaagcctcttttccttccagaactgctgttttatgacagctgtttcggcagtgagtcttgtgtctgttatgagggtgggtccccctcttggccctgctctacagaaaatgatggagcagggcaagctgtcctcagtgaatgtacaccagaatggcctggacgtgagccacgccttcagaaaccatgcgtgctccaagagcgctacagcatcaaataaggcctatggagggtccccatctgaagggcatcggggaggtctctgagtcgaggtaggtgtctcagagaagagggtgacagcccagcctactgcctggagttctggcattgggtagggactgcagagggcccgggaacggggaggctttcagggaagtcctaggggctctgaacacctctgctccttccatgaggacaaggaaatgttgtgcacccagactgccaccttaatgtgcttcccacagcactcaattgatggggcaaggatgcacaggagaccgccccccctccccagtccagtgaccctgctgcccacagtgcctggcttccccactgtagggttctgacccctccagaatgatcctgctcgtctcctctgcacaggaggcagaggcacgtccctgcagggcacagaaaccatgccgacatcccacagcaggggctggggctcagagccggcatcgtgtgcagactgggctaggactcaccttgggagagaacttggggagccccttcttccaggggccacatcccactgagatgagtcgacccccatgaggatctgcaggatcttgtctgacatagcctcattgggaaggggggtctgatactgtgcagagtgggtccccggcactacagactgggatcccaataggctctgctcactccaccagccatcagccttgacaggccaggtcctcccaggcctgctgtccccacagaccccttttgggctcatcctgaggctctgggaggtctgccttctgcagggcgagcacaagctcacagccaggacataagcggcattcaaagttcatagaaacttgtccccatgtgcctgaaggtagcaggaggaccacacaagacagacctcaactgtcctgagggcagcacttgcactgtccacacgaccctctgctctggcctagagggaaggccaagccaagccaggcctggtcagctgtgcagggcaccgtgagtccttctggaaactgagcccacccctgacacgacacagatgaaaggcaggagcgtggtgagcattcccctgcctgggccttccctgcatccatggcctcctgtgcacagctggaccccagggttgtccaaaaggggcccagcactgcccactgggaagtgcccagagcagaaacgaggtgaaggcacagacctctcccaggagaccccacctggcctgatgtgcagccccattcctagaacatctcctgaagctgtctctctttggcccatgggagctccttcaggacatgctgtctcaggcctggactcttgaggaccacgtggtgctcaggcctccatggtcgagttgagaaggacacactgcgacctgcatcccacgtgggctccagcctcccgagtcaccctctgaggcattaaatcatggggagtgcccagaaccctccatccctactccctgggccttcctccttttcctcttccttctcaaagaagtttctgaaaacaggccagctgggccccagggcaggtgctagactcgcctcagtgacagggcatgggatgagggcaagacccctccaagcccctcccccacacccttcccctcctggcctagaagaaccctagggggcactggaggggttggtcccatctgtgcgagccaacacccacagctgccagcaccaacgccagagaacagcaggggcgcctcactcacaagcacccctccaagtgtgtcacgacggcaagccttgagccagggaatggagagaatcagtgtctcagacccagagagaggattcagggaaacggtgcagtaggccccttggtgtgggaagtcatggcatggcgtggattgtccgggatggcagaggggcccagtgcccaggagcgtctcacgcgctatggagacagatcctcatcttaggtggcaagggggccaggtgacaggtaaggcctctcccagctgggttctgcaccagggctgaagcccagaccgagccgccctggggtgagggtatgaggcctggagccccgagccagcctgaaccctggggtccgtctcaggagcagcctgagatgctctgacagcaaccatgccccaagctgcacgcacccctcactctgggttcagcagcctgtgggtgtttcctcagtgtcacaccaggtgggccactagagacccccaaaactccaggggcccaggttcatgaggcccagccctgcaaggaacaaatgggcttggtggagaagtggaccaaatctgcttttctttcagccaaacccgcaaagatccctaggaaggtcctgggcctggagcgagtgtccctggcacccaggcctctgtgggcatccctcagcatgcagaccctccccaagggggatgggctggccctccgtggcccaccagcccagctccagaagtccagaagctgaccctgaggccaaggcccagcagcatgaggggacttctgcagagccccgggcagcaggacactctctgggggctcagccgcccagagtgcagcaagtctgttcctatctcaggacagaccccaggattttgggcgatttctgtgtgggtgtcctctcccaaaactccccatgtacctggacatccagggctcatggtttctacagtgcagctttgagcaggcatgctgaactcctattccttccacatctgctctggacatcgccaggaccaatggacaggcccatccctgcaaccccagcagggctccaacaaccagacccggcccaccccactgaaaacccagaggtaggaccacagaaactccccttgcatggtggcatctggatctgacgtttctctgaggatagtgacctgcacagccccaaagcagtcagtactactgctaggccatatgggatcaatatcaatggggaagctgggccctcagaggctgctggaggggagagtgactgtggcatctgcacagccccagccagccagcagcatatcacatgtcctcatgtctgcccattcgtgtgacagagcctctctcacatggcaagcgtcctagagccatggggctgcgatccagcccaagccctccccaaccaaagccctaagagaaaaaggacccaggggagccatgggtgccccagaaacagctaagatggatacacaggggactgagttcctgggacactggccagaactagactgtggcccaaggcagggcaagccccttaaagcagtgtgtgggtacgcagggcctgtgcatgcctggcagagccaagccagtgacgttaccaggctcaaagagcaaccatccacgacggccatggtggggcaggagcaggtgggccagccccctgcctcatcaactcaaggaatcagggatggctgggttcccaggccctgagtgcccaccacctgaccattagtgaggcagagacatgaggccaatcacatgatcctggggccctgcttccatcttacaagaactccttcagctcacagcaccaagaaaaatcctgggcaagtgagggtccaggaggccaggttcctacgtctattctccttgtcaggtgcattttgccactgggaaaagtcagaaaaggtggcctcagtccatgtaagcaggctccaaagtaggcaccatagctgcagggggagaaggagctcctggcggcactggaataggctctggcaggatcccagattctgtgattctgtcccccgcaacctgttttttgttttgtttttttttttgttttttttttttttttttccccttgagtgcttggaatcgtccccattttacacggagtctgcagccattgacaatcagtttattagaggacttgtcggcacccacttctgtagccaccctgtggaaagctggatgaaaggcacactgctatctctgcacaacggtgaccatccggatctcaccaacaggcagagacaatttcttaaatctgtctgagtaatggtatccgccagatcaccaacatacactctggtggaatccttctctgctggtgattcaagatgaagcgtggttgaagcctgctttagaagcttatctgctacagggtcattgtttccacaatatcgatctttaatattttgaccagcaagagggggtcatcgggatctgcaggcttctcatgtctttacggacagtcctctcctttcacctggacagaacaaatgtaaggcttattcctcagccagtacagtgtggtccgggccagtttgagcagcatctcactactggacgtggctttccccagcagagcaactggccatgttctatcagggttagaaattcctctgtccatatctgcagtcacctttaaaggcaagtctgtgtcatgaacctgtatgggcagtcatactctaggtctaagaggcaagtctgacagacatttcctgcaggcttggcccccttcagtcttcttgggatgcatgtgctcccccgggcaccagccaaacactgaatggcctgacagagtttgcattttttctcatagttctccttggtcatgtttctctgagacatatctggcacagaatggagaaatcgacgtcctcccagttttgcctgttttaggcgctggaacccagagaggtcgccatcttgagagggtcggcaggcagcagtagatttccaggtgggagagaggacccccagaatcccaccagacccagctctccttcctggtgctgttcttgaggccctggataattgcctttcaccatacgtgagtcatctttcttgagtcaaggtgaacctcacttccaaggaatccccattcttgtaggacactctgtgcttcctggtctctccaggagctggctaaaattctatgctttttcattggaatactgagatagacagaagtgcagtttttttacaagtgtctttatccagccatggcattaatttcccgtttggtaggaggacaatagtcttattttcatcagtatgtgtagtgcatgttagtgcacagcatgaaccttagaggaagacttctaccttgagatgtgaaatgcatcaatacttgtgtggagttaataaacctgctctacctccacaagtgtcagcttcctcacccatacaatggggatcacacaacgacttcttcaagttgttgccagagttacattcaccaagatatttaaaagtacctaactacaagggtccacagcattaataaaactgcatcagacttcaatgcacacaaaaggaataaagtacatgcgtccaaagacgagatgagcagctttctaagcagcctgatgagcatcagaatgagatctacatttaagtagaattcttcacagctccactgaagaggacacacatgggggctccaagaagataagcacatggccattgcacagtaactggtgtagtgtggatggaatccctgaagaccctctgaaatatcattacacaactggctctcagggaacactggaacaaatcaggaaactcagcagatgctaccaggaactgggtgagcagaggggggtcacatccacaaatttaagcagaagacaccaaaccgcaaggagctcctggctctgcaacagcagctgtggtggcatcggggccaatcttctgagacagctgctgtgggattgctgagaccatgtgtttttgcagccacacacccaaaagcagtgcatttgaaaacggatcacaacactctcctctccattcatctttgttttaagatgactgatgatggataccctcacattgcaacatccccaccaacacttgtggacaatcgtatttagaaaatcccacctaaagagggaacagtcaggagtaggatgagaatattgagggatgggggagagatgcgggtacttcaccccagactctgtttgaaacaagagccattgtgctgtggtctccctatacttcctcattttgccgcattcgtagatgccacctggtttttgtccctttacttacaaaggtgctgatgagcccatgggtggttaatcctgaaggaggaaattcttcacaaaatacaataacagagtctaatttcaatgaccaggttttttagtttttttttttttttcatagtatcccacattaaaaatcacaaatgaaacctgttggaatgtgtgatatgaacaaagtcttattttcatgcagattaacaacttggcttttacggattacacataaaagcataaaagctggtaccatcccagaatcaaaggaacagtcccagaggacatacggaatttagtgacatcaattattaagaggctacacgaaactggaagtgctcccagaagttttcattgtctagacagaaaaattcaagacatcagccccagcgagtaaaggtacgtcccctggctgccgtgggtgatgagcttttcattcaaagcagagatatgaagcctgaggtgtctcaaagtcaccccaagtgctccacaccttgaaagtcactcccacaaagctggaacaccatctgttcctgaaggatcaggtcatgacctgtatctttgagacactgggcagtcaggcctcagttgagatgaagccaatgatttcaagtgtaaaatacctaaaaccaaatctttaggtatctattagcagccccgtccacttaaatgggttggtgaacatggcccatcagacagacacacacctgagcactggggttttctcctctgttcttagcatcccctgggtaaaccagtaattaccctccctcatgcctcaacgttcacatctgtgaaaaaggtgatggggagagtggcctttccaggaaagcggagcacatgtcaacacctgctaagctctgaatttgtgcgtgggcccaggcgacggatttctccagaaagcggctgaactgggactctggctgaagagagcggaggtcagcagcacaatgcacagcccctgggacctcaggccagttccatagcagcttaggaaagcagttgggtccctaggctggaggaggcccggtgctctggaaagatccagggtgcgggtggagaggaaacggagctgagcagtgagaggtggggtgagcaccacgtccatccggtttgggcaaaggcaaggtgtcctttgcagtgtcacaccctcctcactactgagcccagaactgcctctcatggccttctccagactcacttcccatggccaggaggtggcacatgatcagtagccggcacatgatcagtagccagcatcattcttctatacagttaacttcttattgactaccgtctctcggctgtgctatcaaataggacgtcttattcagtctttctaactatgtttttggtacccattaccatccccacatcccccaagctccccactacccttcccagcctctggtaaccatccttctactctctgtgtccatgagttgaattgtttggatttttagatcccacaaataagtgagaacaattgatgtttgtctttctgtgaatggattatttcacttaacatattgatctccagttccattcatggttttgcaaatgagtggctctcaattttttttatggctgaagagtactcccttgtgtgtatgtgccacattttcttcattcctctgttgctggacgcttaggttgcttccaaatcttagctattgtgaacagtgctgcaacacacatgggagtgcagatatctcttcgatatactgctttcatttctttggggcataaacccagcaataggattgcttgatcatatggaagctctatttttagtttgtagagaaacctccaaactgttctccgtagtggttgtatattacattcccactgacagtgtatgagggttcccttttctccacatcttcgccagcatttggtatttcgtgactgttggttaaaagccatttgaactggagtgagatgatatctcattgtagttttgattggcatttctccaaagatcagcgatgctgagcaccttctcacatgcctgttttccatttgtatgtcttcctttgagaaatgtccactcaaatcttttggtgatttcttgatcagatattagattttttccgatagaattgtttgagcttcccgtatactctggttattaatccctcgtgagacgggtagtttgcaaatattttgtcccattctgtgtgctgtctcttcaatgtgttgattgtatcctctgctgtgcagaagcttttgaacttgatgtgatctcatttgcccgtgtttgctttggatgcctgtgcttgtggggcattactcaagaaattttcgcccagggaaatctacaatctaaatgtcttgtagagtttcctcaatattttattgtagtagtttcatagtttgaaagcttagatttctttaacccattctgatttgatttttgtatatggtgagagataggggtctagattcattcttctgcatatggatatccaggtttcccagtaccatttattaatgagactgtctttccccagtgtatgttcttggcacctttgtggaaagtgagttcactgtaagtgtgtgggtttgtttctgctttctgtattctgttcaatgggtctatacgtctgttttaatgtcagtaccgtgctgtttgggttactatctctctgtagtatgatttgaagtcaggtaatgtgagtcctccagatttgttcttttttgtttagaatagcttggctattctgggtcacttgtggttccatatgaattttgtgattgctttatccatttctgtgagaaatgtcactgtctgttgttgtttgttttttttttttagggattgcactgaatctgcagattgcttgcttgtatatgttttagaatgagttttgctagctagtgtccttcaaataattttttctttcaatataaatataagtttttggataacatttcttgaaaggttccctgttgtacatttaatatctaaaggatctgtattgacgtaacgaccctctgggtttgctgatattaatatttgtagtctctgtgtctccctctctcatcagtctggataaaggtttattaattcgagttgtcttctcaaagaaacaatgtctgggtttcactgataatttctatagatttttatcaattctatttaattcatttttcctcatgtcttttaaattttttccttctttttttctcctttttttttttttttttttaacagaatctcgcactgtcacccaggctggagtgcagtggcatgatctcggctcactgcagcctgcacctcccaggttgaagagattctcctgccttagcctcccgagtagctgaaactataggcgtgcaccaccagcccagctaacttttgtatttttagtagagaccgggtttcaccatgttggccaggctggtctcgaactccagacctcaggggatcggccacctcagcctccaagagtgctgggattacaggcatgagccactgtgcacggtctaacagttttccttctgactttgggtataatttgatttcatttttctagtttcttaatgtggaaacctagataattgatttgagacttttcttcctttctggcataagtattgaagggtataaatttccctctatgctttagtttcatcttgcaaagtttgataagttgagttttcattttaaaattttttcctgcaatttcttctttgatctctgagttacttaaatgtgacatttaatttccaagatttcatgagttgcagacatctttctacaactaatttccatttcaattctttttttggtcatagaacatgttttataacatttcattccttttgaatttgttgagatttgttttttggcccacaatatggtctatcttggtgaacattctatgagcacttgagaagaatgtgcattctgctgttgatctatgaatatcaattaggccatgctgtctgatagtgttgttcaagccttctgcatttatatatcctgattttttgtacactttttctaccaaatgctgggagtaatggggaagtcttctactaaaggcacatgtgtttatttcttctttgtgatgatgtatcagttgtccctcaagtattttgaagttgcctacatatccgtggtgtttctgtcttctgaatcaatgcacctctctatgattattatgtaatgtcccactttgtcccttgtagtaatctccactataaagtgtgctttgtgagatactaatttcacactttgagtttatgtgattcatatttgcaggaaatatctttttccatcttttacttgtatcttatttatttgtagagtggggctctttttttcaagatacagattactgataaatatactgtgaaaatcaagatcctcttgcaactgtgcaacaacaataaaagtaccgaaaaattagatgcagaagttaatatacaactaaaatgttacgcagaaatccacagaataatctgctcggctcttcaaaagaacctcaatcaaactctttgacagccttcatagaaagatatcttcacattaaagtggtatatttatatgaaaaatataattttatccccctattttctacagtagggttttgggtaaaatttcatttcacgaaggtgttcttttgctaaaaatcctttgagaaacaactatataaaatgatctctcagagctctcttagctttgaaatgtggagattcaaatatccctctgtagattgaggaggagatgtaaaaaaaaaaaacaaaacaaaacaaaacaaaaaacaaaaaaaaccacgggggaggaaatgttggtctcctgcacttttcttttctttttcttcctagactaaccagtttgtgttggtcctccgctgagctgttaatccagggaagagttgcccttctgaagaatatgtggatttaatggagaccaaggcaggtttgaatcgctcagaaacaacagccagaataacttttgaagggctgtaaatgaagatgattcaaatcctctgatttatgttacttttcactcaagtttctaaaagtgccttcccatcaagagctgtttggctagggacagaaacgtttgttcagccctatttttctcttccttccttccttccttccttccttccttccttccttcctgcctcccttcctgcctccctccctccctcctttacttctttccaccctccctccctcgctccatttgtccttattttctcccttcctccctggctcccttcatgcctcactcccttccttctttcctaccttttataaaaagaagtgaactgatatttgtaaagtagaaagatcagaagagttcacaattattttcgagttttcttttaacttttattttgggttcagggtgcatgtgcaggtttgtaatataggtaaactcatgtcatggggtttgttgtacagattatttcatcacccaggtagtaaggccagtgcccattagttattttgttgatcctctccctcctcccagcctctaccctctgataagccccagcgtgttggccctctctgggtgtccatgtgttctcagcaattagctcccatttataagtgacttcatgtggtattgggttttctgctcctgcattagtttgctaaggataatggcctccagctccatccgtgttcctggaaaggacatgatctcactgttttttacggctgcatagtactccatggtgtatatgtaccacattttaaaaagtgcagtctgttattgatgggcatttaggttgatcccatgtctttgctattgtgagtagtgctacaatgatcatacatgtgcatgcgtctttataatagaaaggtttatgtacctttgggtatagtcccagcaatgggattgcagggccaaatggtatttctgttcttaagtccgtgaggaattgccacactcctttccacaatggttgaactaatttatactccaaccaacagggtataagcgttgccttttctgcacaaactcaccagcgtctgttatttttgttcttgctttttatccagccttatagactctgactctgttttttgagacaggatgtctttctgtctgtgaacgtgaattccgctggtgtctgagacttgccaggattccagctctctcaaatgcctgtgttcgaactttatgaatttgctacattttcactggttttcttcttaccccctgttatggctgtcacttcttccacacatgctctgccacaggtgatgcagtttgtttgtctcatccctcctcagagggactaagtcaccattttggatcagttcccatggctgccttgttacctcaggtctctcatgatctaaaaacaaagcaaaacaaaagataacgttatagattattaggctgtttttcattttcaaggctaaagtgactttctcttgaggctttctaaatcttacctggtggtagaactctcctttgttaatcttttgactactggtacaaaaatacagcattcaaatatgtgaagtaaaagataatccaggggctagctgactatggcttgagatctaaatacagcccatggcttgttttgcatagccattgagataaggatttttttccatttaaaagtattattgctaaaaaacacaacactacgccacagaaactacatgacccacaaagactgaaataattacgatcagatctgttaaagcaaaatttggtgatgccgtattaatcaaatacctgttattctgctttgcattattgcatacatcttttcatccattaattaatttatttacacacggattgaaaatatggatgttactctatcccctcaagaaagcgtccagctttatgataccatgatttcagtctgggaaacttgtcccagggatcaggtcaatacacaaacatacatttgaggtaggagactggcaggacttgttttctggtcataactgagcctagagcctacagtcagaatctatggctatttctgaaacatatactgtctgaatgacctacaggtatattcagggaaatcagttaccagtccagagatttaaatgtgaagtaacacaacctaaaaagaaaagagtaaacaggtgtgaatgtatttattctacagaagaatttattcaattacgtttattggaagcatggcagaaaacccagaaccagagaacaaagtgattaataaaagcatttataaaactggccaaggtgggaggatcacttgagcccaggaaattgagaccagcatgggcaacacagtgagaccactatctaaaaaataaataaataataaataaaccaattacccaggtgtggtgtctgcacctgtagtagcagggactggggaggctacatcgggaggattgtttgagcccaggagatggaggcttcagtgaggtatggtcatgccactgccctccagcctgagcaacagagtgacactctgtctggaaaaaaaaataaataaaaacggctttataaataaagatatgaaaataatttatttcttccacaaaaggtcttcctgagacacatcctccagtaagggactgtctgttcccaacgtttctgaatgcatgagattggacaaagagagacgaaagctctcaagtccctttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagtgtgagtgagtgtgagggggagcgtggggggcttcctgtgggttgtgccacttggtccatggcctctgaggtcgtcatctttctactaaaactcagcgatactgccatggccttgctgttgtggggtcccgggcatgggacgaaggagggccatagcggggaggagggtcaggtgagcatggagtgagtttttttttttttttcacggagtcttgctctgtcaccaggctggagtgcagtggcgcaatctcggctcactgtaacctccgcctcccgggttcaagtgattctcctgcctcagcctcccgagtagctgggagtacaggcgcgcacaaccacacccagctaatttttgtatttttcagtagagacgggttttaaccatgttggcgaggatggtctcgatctcttggccacatgatccacccgcctccgccccccaaagtgctgggattacaggcgtgagccaccgcgcccggtcatggagtgagttttgaaggctgactttatttgaggtatttgagtcctggtgggggggaacccacacacagagaggagggattccaaagtcgttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaagaagtcttgctcatctttggttcacttccttcccaggtatttgataatattggaaatcgtttctggctgcggttgtccacgcctgtaatcccagcactttgggatgctgaggcaggaggattgcttgagctcagtagtttgagaccagatggggcaacaaagcaagactctctctctacaaaaataaaagagtgaatgcatgaatgtatgcaagtttgtatgtagctatagccccagctactctagagccgaagggtggaggatgcctccagcccaggaggtccaggatgaggttaatttttttttgagatagagactctatttttttttttttttttaaaaattcagtatcatttttgaaattttgtgttctgattgagctggtatgcacaggtgtgatattgtgtaatacatatttggtcctagaccctgcttcctggcatacaactactacaatttttaaaatctccacaaagtggtgtctttttatatgctagtgagttgactcatggctggcagcacctaggtagctctagtttggggaataggagggttggggctttcagctgcccctccccccccccagcattcgggaagaggcagaaggttaatttgatccccagtggcaggacaacagtttaatcagtcacgcctacagaatgaaaacctccatcaaaaccaaaaggacaggattcagacggcttctggctagctgaacatatggagggcagcatgcccctagtgggcacagaagctccctacccctttccccataccttgcgctatgtctctcctcatctgcttcctttcttagggtatcccatttgccacaaaacatgtgagaagtccctaggctatagagctggatgaaagaattagggcctaggtaggagtaagcggcaaggaaccagggcaacttgctgaagcaagatgacgggtcctacctacaccgtctctttagaggctatgtcatgaagtagccatgggtttccatcttgcctctcacacagtgctcttgatatggtggtcaagatacttacaccctttgggactgtttttccatttctaaagttgaatttacaatatgtacactaaaaatacttagtatgaaaaataaaggaaataacatcaaggaggctttacattgcagataaatttggcctgctacttagatttccttttttcctttagatttcaaactttttcatttcatttttccttacaactacatttctggtgtgtgataacctgcttttgaatttcaagtaggaatatcaagttcacttttaaaatacatttgaattcagaaaattatttgatttaaatatgttaatttaatagcagtgtagccggtgtcacccacggcatagattctgaagttgatttgtaaataaccgaggtgttataaagccaactgaatgtcagcaatgtgtgctgaaaacttgtttgctatgtgttatgcgggtggatcacctgaggtcaggagtatgagagcagcctggccaacatggtgaaaccccatctctactaaaaatacaaaaattagccagatgtggtggtatatgcatgtaatctcagctactggggagtccgaggcaggagaatcgcttgaacccaggaggcggggcttgcagtgatcggagatcgtgccattgcactccagtctggaaaataaagagtgaaactctgtcaaaaaaaaaaaggaaggaagaaaggaaggaaggcagacaggaaaagagaaaaagagaaagagaagggaagaaaatgaagaaagaaaaaggggagagagagagagaaggatggagagggggaggaaggaaggaaggaaggaagggaagtccctctgtccgtatttgcagtcactttaaaggcacgtctgtgccatgaacccggatcggcagtcatactctaggtctaagaggcaagtctgaaagacattgcctgcaggcttgacatccttcattattcttgggatgcacgttctccccagggcaccagccaaacaccgaatggcctgacacagagtttgcattttttctcatagttctccttggtcattcagataatatgggttctctctaagacatatctggtgcagaatagagaaggttgcatcctcccagttttgcctgttttaggtgctggaacccagacaggtcgcaatcttgagagggtcggcaggcagcagtagattttcaggtgggaaggaggacccccgcaatcccaccagacacagctcttctttctcatgctgttcttgaggccctgggcaattgcctttgaccgtatatgattcatctttcttgtgtcaaggtgaacctcacttccaaggaatccccattcttgtaggacactctggacttcctggtctctccaagaactggctaaattccatgtttttccatcggaatactgagatagacaaccttgaagtgcagtttctttacaagtgtctttatctggccatgacattaatttcgcatttggtaggagggtaacagtcttattttcatcagtatgttcagtgcatgttagtgtacagcatgaaccttagaggaagacttctacgttgagatgtgaaatgcatcaaaagcttgtgtggagttaataaagctactctacctctacgagtgccagtttcctcacccataaaatgaggatcacaagatgacttcttcaagttgttgccagagttaaattcagaaagatatttaaaagtacctaactgcaagggtccacatcatgaatgaaatagcatcagatttcaaagtacacaaaaggaataaagtacacatgacctaagatgagatgatcagctttctaagcagactgacgagcatcagaatgagatctatatttaagcgatttcttcgcagccccactgaagaggacacacatgggggctccaagaaggtacgtacacggccattgtagaggaactgatgttgtgagggcggaatttgaaatgtcattacacaactggttctcagggagcactggaagaaaccgtgcaacccagcagatactaccaggaattgggtgagcagaggagggtcatggccacaaatctaagcagaagacaccaaaccacaaggagcttctggctctgaaacagcagctgtgatggcataaggagcaatcttctgagatagctgctgtgggattgctgagagcacatgattttgcatcaatacacccaaaagcagtgcatgtgaaaacagatcacaaaactctcccctccattcatctttgttttaccatgaccaatgatggataccctcacgttacaacatccccaccaacacttgtggacaagtatatttagaaactcccacctaaattgggaacgctcaggagtagggtgagaatattgatggatgggtgagggatgtgggttcttcacctcatagactctgtttgaaacaagagaagagctgctgtgctgtggtctccctatacttcctcatcttgccacattcatagatgccacatagtttttgtccctttatttacaaaggggctgatgaacccatgggtaattaatcctgaaggagaaaattcttcacaaagtacaataacagggtctaatttccatggccaagttttttaggtttttttttttttaatagtggctcacattcaggaatcacaaaagaaacctgttggaatgtgtgatatgaacaaggtcttattttgatgtagattagcaactaggcttttacagattagacataaaagcataaaagctggtaccatcccagaatcaaaggaatggtccctgaggacatacggaattagggacatcaattactaagaggctacaggaaactagaagtgctcccagaacttttcattgtccagatagaaaaattcaacaaatctgctctaataagtaaaggtacctccctgactgccatgggtgatgggctttccattccaagcagagaagtgaagcttgaggcccttcaaaagcaccccaagtgctccacaccttgaaagtcattcccacaaagctggaacaccatctgttcctgagggatcaggtcatgatctgtgtctttgagacactggccaaacagactctgagtcctgaatggatcttcactgggtaactgcatctctattcctgcattctgctgagatggttgatggagccatgagtcacatacctcacctcttaagcaatcaattgtccagctacatccttggccatgttttcatggcatgctatctgaataggctgagaatcttccaaatcatcacaggctgatttctttttcttagcagttctgttgttgatttatttctcctctcttggattttgctatcagcagcagggagaaacatggcaacatcttcaatacttggcttagaaatcttagctaaatacccacgttcatcacttgcaaattctactttgcatctaagagtatgcagtttagctaaattctctgcgattttctcataaggaatgtgaatccatgtttccaataacatgttccccattcctgtctgagacctcaccggaagcacctttaacattcatttttctagcaacattctgttcttgatgttggatgtattctctaagatgacagaaattttctgtatagctctcctgtttttttctgagcacttgccagaatttatcttaatgtccatatgtctaccaattgccccttcaaggaagtgtaggctttttctgtcacttactttgaaactcttccagcatctcttcacgacccaattccaaagctactttcatgctgttaggtatttgttagagccgcacttcatttcctggtaccacaatctttgagagttctctagggctgcagtaacaaatcaccacaaactcactggcttcaacaacagacatttattgtatcacagttccggaggctaagagtctgaaatcaaggtgtgggcagggttgactccttctgaggcctgaatggaagaatctgttccatgcctttctcatagtttctgttggcttgctggcaatccttgacattcattgaccagtagatgcatcacccctatctcttccttcatgctcacgtggttttttccctgtgtgcacgtcgtagtccattttgtgttgctataaaggaatacctagaaccaggtaattcataaggaaaagatatttatttagctcacagttctacaaactgagaaattcaagggaatgcatagccctctggctttcggtgagggatttcgatccacatcacaacatggtggagaaggccaaagtggaagtggacacttgtgaagaggggaaaacctgaggggtgtcgtggctttacaacaacccactttaaagggaatgaatccattccttcaagagctactccagcattctgaaactgagaactcacttaccatttcaccaagagatcagcaccaagttattcataagggatccacatccataacccaaactcatcctaacaggccccacctcccaacactgccacgggaagtggggggtcaaatttcttttttttcctttttctttttttgagacagagtcttgctctgttttccagtctacagtacagtggtgcgatctcagctcactgcaaactgtgcttcccaggttcaagtgattctcctgccgcagcctcctgagtagctgggacaacaggtgcatgccaccacttccggctaatttttgtatttttttttttattagatacagagtttcaccatgttggccaaactggttttgaactcctgacctcaggtgatctgcccacctgccttggcctcccaaagtgctgggattacaggcatgagccaccgcaccagggcaagggggtcaaatttcaacatgagttttcctggagacaaaccaaccatacccaagccataccaacgtctgtgtacaaatttccccctcttctaataacaacagtcatattagattaggggcccacccaacctcattatgacctcatctgaaattaattatattttcaataaccctatttccaaataaggtcacattctgcggtacctggggttaggacatcaacatatgaatttttcaggaaacccaaaataaactatgtgtattttgccacaataaaaaatgtttaacctcctcctgtgcagtaaactgcttcaagggcacctttggaaacatctccatgtgaacctcactgtccagaaagcttctttcacaataaacaccatagaaagctcttgacaggtatagtctccacaagaatttgaacaacagccactcccatctcctctgctctcccctgtattgctacttgttgctgctgctgctgctgctggaatgttgataactactcctccctggatcccttgcagagggttgtgcgccacagtttaccaggtattgctaataatatgccctattataaggtttgggaattagaagtaattttttagttctaccaaaaatggttgcagtgtgaatcgtgaatgtggcaaagtttaggcaggtgggaatggcgaatgtgagaattttcagcaggtgcgcatggtgaatatggaatgtttaggcagatgtgcatggtgattgtggaatatttgggcaggtgtgaatcgtgaatgtgaaatgtttgggcaggtgtgaatagtgaatgtgggaatgtttggacaggtatgaatgatgaatgcagaatgttctggcaggtgtgaatggtgaatgtgcgagtgttcaggcaggtgtgaataatgagtgtgcgagtgtttgttatggccccgggattcccctactgatcacctgcctcaggattccaggaggcagagacatttggcagaggtttcctccagttgcctgaccatcaggtatatttcagtggactccaaatctagtatgatttccattatgtctgtaggttttatgagacttgaagattcttcattactattttctgtactgataatttaattaataattttctgtacatataatttaataacacatgaattcatgataagaaatgtaacaaatttgactttctcagttacattccactcaaaaacacatgagttttgtctgtttgactagtacttccattcctggtaaggttcagcaagagctgagatttctgagcttcagtgactacatcctaccttgcaggttacttgcaataatgaaataaatgatagtgataatagtagtaaaaatagtagtaaaagaaggctgggctcagtggctcatgcttataatcccagcactttgggaggctgaggcaggaggatcgcatgagcacaggagttccagaccagcctggagaacatggcgcaaccccccgcccctgtctacaaaaaggttaacaaaatttagtccagtgtggtgtcacacgcctgtactgccagctactaggaagatgacatggcaggatccctggagcaaggagttccagacagtagtgagccatggcaaagtcagtgcactccagtcagggtcacccagtgagacttggtgtcaaaaataatcagttttaatataaaaccaacagtcatactgttacggactgacttctgtctgcacgagattcatatggtgaagtcctaacccctagagcctcagactgtaactgtatgtgagatagatggggtctttaaaaaggtaattaagtgaaatggggtcattagagtagagtctaaggcaatgtgcctggtgcccttacaagaagaggaaatgaggacacagacttgtacagagggagggctaaggcagacacggagaaaacagctgcctgcaaggcaaggagggaggccttagaagaaaccaactctgctgacaccttgatctcagatgtgtagcctccagaattgtgagaaaatacatttttgttgtttaagtcacccagttcatggtagtttttgatggcagccctaacaaaccaatagaaacacttttagtgccgctcagaaggcaagcattatcatatctattttatgagctagaactcctgctcctccaactaatataatgagcatgtaatgatacctgtatctgagcaactgagcagtgatgagaaaacttcaaaactttggaattattttaccttaagtctatgaccacgagagaatcgcttctccctttcgcactcatcctacttccactactacaatactctcacaaattcctaggaaccctcctccatttgaatgacctaccctaatgattccttcagaagacagaagctatctgctgggaattctcagagcatcccaaacccaggctacccctgttgggcctggcattctctgccacccttgtgcatacaatgctcctaacggaagcaagcccctcacctcagctcaggatcccataactcccactttcccaggggctttcctgctgcaatgatcgttcttctctcctgaaccatcaatggctccccctatattggatcactccccaagctaagggggaaactcactttcttcccccatgtccttctatagctacgaatacatttagctgctgcccttcaaagcaaaactgcctcaacatatacaactcacttcactggagtcattttccaaaattacctggcaacaaaaatgaaccagaacagctgaaacaatgctgaactataactttggggaactcacactacctaatagtaagagtgatgttaattctatagtaatcaagagaacgtggtaatttggaaaaatcaacaaatcagaatggagtccagcaatagactcacagacatgatatattgattttcagaaaaggtgcaaaggcaatggagaaagattgtcttttcgtgaaagtgttattttcctcctgcctcttggccactacattgattggtttttattcccctgggtcccttccctgtgtttccccctttgcacttcagctgctcttctgtttagtggcctctctgccccaccacagtgtgacagcccccacagcaagtaccatgtgttgttggttgttcttccaatttccagcatcccaggtatttcttgtaacatggcaggccactcatgcatgtctactgaattgatgaattaaccttttgtaatgatcctaacagaaaagcatctcctgtgtttaggagacattattggagatgatatgtttctaggcaccttacatatggtctttggttttgtgccggacactctagggtaatggctctgtatgttgctctggagctcctgcaggtcaccactaataggggaagtaggcaaagctagactacaagctaacctgagtctgggcacaatatcttgactgcccttggaacaaggaaagataggcagggcggtgggagctgccacaggtatttttgcaccagctccctatctgcctggaggctgacacaaggccattcttcatccgtctccctagtttgaggtaagcacaggcctttcttcatcatagggtacagttgtggagtataaaattgctcactgcctttgggcacaggtgtgggctcctcaccagcagaaagacccactatctgtgctgtccatcactgagtacctccgattcactgtcacactatggaaatagggatacggtgcttacacaatgctgatcttgcttttgctttctctacaagcaatcaaccacttggatctgtttgggctcattgtctccgtattggccaaatttaagaatatgtgaaaaggcaaactaacgactttagtggtgatcctcatggcccttttaggacaacacagggctgcttacggaccgcttgagtaattgacacactactgtattgagttgcgtggtgtagcatagacagaatattgatttagtcttcatggcatcacacacagcaaataagttttcagcacatactattgacttatggttggccttgtaacacctcggttatttacaaatcaacttcagaatctatgccgtgggtgacaccggctacactgctattaaattaacatatttaaatcaaataattttctgaattcaaatgtattttaaaagtgaacttgacattcctacttgaaattcaaaagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttttaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacgatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccgtaaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaaggaaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttttaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacgatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccgtaaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaaggaaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagatatcatctcactccagttcaaatggcttttaaccaacagtcacgaaataccaaatgctggcgaagatgtggagaaaagggaaccctcatacactgtcagtgggaatgtaatatacaaccactacggagaacagtttggaggtttctctacaaactaaaaatagagcttccatatgatcaagcaatcctattgctgggtttatgccccaaagaaatgaaagcagtatatcgaagagatatctgcactcccatgtgtgttgcagcactgttcacaatagctaagatttggaagcaacctaagcgtccagcaacagaggaatgaagaaaatgtggcacatacacacaagggagtactcttcagccataaaaaaaattgagagccactcatttgcaaaaccatgaatggaactggagatcaatatgttaagtgaaataatccattcacagaaagacaaacatcaattgttctcacttatttgtgggatctaaaaatccaaacaattcaactcatggacacagagagtagaaggatggttaccagaggctgggaagggtagtggggagcttgggggatgtggggatggtaatgggtaccaaaaacatagttagaaagactgaataagacgtcctatttgatagcacagccgagagacggtagtcaataagaagttaactgtatagaagaatgatgctggctactgatcatgtgccggctactgatcatgtgccacctcctggccatgggaagtgagtctggagaaggccatgagaggcagttctgggctcagtagtgaggagggtgtgacactgcaaaggacaccttgcctttgcccaaaccggatggacgtggtgctcaccccacctctcactgctcagctccgtttcctctccacccgcaccctggatctttccagagcaccgggcctcctccagcctagggacccaactgctttcctaagctgctatggaactggcctgaggtcccaggggctgtgcattgtgctgctgacctccgctctcttcagccagagtcccagttcagccgctttctggagaaatccgtcgcctgggcccacgcacaaattcagagcttagcaggtgttgacatgtgctccgctttcctggaaaggccactctccccatcacctttttcacagatgtgaacgttgaggcatgagggagggtaattactggtttacccaggggatgctaagaacagaggagaaaaccccagtgctcaggtgtgtgtctgtctgatgggccatgttcaccaacccatttaagtggacggggctgctaatagatacctaaagatttggttttaggtattttacacttgaaatcattggcttcatctcaactgaggcctgactgcccagtgtctcaaagatacaggtcatgacctgatccttcaggaacagatggtgttccagctttgtgggagtgactttcaaggtgtggagcacttggggtgactttgagacacctcaggcttcatatctctgctttgaatgaaaagctcatcacccacggcagccaggggacgtacctttactcgctggggctgatgtcttgaatttttctgtctagacaatgaaaacttctgggagcacttccagtttcgtgtagcctcttaataattgatgtcactaaattccgtatgtcctctgggactgttcctttgattctgggatggtaccagcttttatgcttttatgtgtaatccgtaaaagccaagttgttaatctgcatgaaaataagactttgttcatatcacacattccaacaggtttcatttgtgatttttaatgtgggatactatgaaaaaaaaaaaaaaactaaaaaacctggtcattgaaattagactctgttattgtattttgtgaagaatttcctccttcaggattaaccacccatgggctcatcagcacctttgtaagtaaagggacaaaaaccaggtggcatctacgaatgcggcaaaatgaggaagtatagggagaccacagcacaatggctcttgtttcaaacagagtctggggtgaagtacccgcatctctcccccatccctcaatattctcatcctactcctgactgttccctctttaggtgggattttctaaatacgattgtccacaagtgttggtggggatgttgcaatgtgagggtatccatcatcagtcatcttaaaacaaagatgaatggagaggagagtgttgtgatccgttttcaaatgcactgcttttgggtgtgtggctgcaaaaacacatggtctcagcaatcccacagcagctgtctcagaagattggccccgatgccaccacagctgctgttgcagagccaggagctccttgcggtttggtgtcttctgcttaaatttgtggatgtgacccccctctgctcacccagttcctggtagcatctgctgagtttcctgatttgttccagtgttccctgagagccagttgtgtaatgatatttcagagggtcttcagggattccatccacactacaccagttactgtgcaatggccatgtgcttatcttcttggagcccccatgtgtgtcctcttcagtggagctgtgaagaattctacttaaatgtagatctcattctgatgctcatcaggctgcttagaaagctgctcatctcgtctttggacgcatgtactttattccttttgtgtgcattgaagtctgatgcagttttattaatgctgtggacccttgtagttaggtacttttaaatatcttggtgaatgtaactctggcaacaacttgaagaagtcgttgtgtgatccccattgtatgggtgaggaagctgacacttgtggaggtagagcaggtttattaactccacacaagtattgatgcatttcacatctcaaggtagaagtcttcctctaaggttcatgctgtgcactaacatgcactacacatactgatgaaaataagactattgtcctcctaccaaacgggaaattaatgccatggctggataaagacacttgtaaaaaaactgcacttctgtctatctcagtattccaatgaaaaagcatagaattttagccagctcctggagagaccaggaagcacagagtgtcctacaagaatggggattccttggaagtgaggttcaccttgactcaagaaagatgactcacgtatggtgaaaggcaattatccagggcctcaagaacagcaccaggaaggagagctgggtctggtgggattctgggggtcctctctcccacctggaaatctactgctgcctgccgaccctctcaagatggcgacctctctgggttccagcgcctaaaacaggcaaaactgggaggacgtcgatttctccattctgtgccagatatgtctcagagaaacatgaccaaggagaactatgagaaaaaatgcaaactctgtcaggccattcagtgtttggctggtgcccgggggagcacatgcatcccaagaagactgaagggggccaagcctgcaggaaatgtctgtcagacttgcctcttagacctagagtatgactgcccatacaggttcatgacacagacttgcctttaaaggtgactgcagatatggacagaggaatttctaaccctgatagaacatggccagttgctctgctggggaaagccacgtccagtagtgagatgctgctcaaactggcccggaccacactgtactggctgaggaataagccttacatttgttctgtccaggtgaaaggagaggactgtccgtaaagacatgagaagcctgcagatcccgatgaccccctcttgctggtcaaaatattaaagatcgatattgtggaaacaatgaccctgtagcagataagcttctaaagcaggcttcaaccacgcttcatcttgaatcaccagcagagaaggattccaccagagtgtatgttggtgatctggcggataccattactcagacagatttaagaaattgtctctgcctgttggtgagatccggatggtcaccgttgtgcagagatagcagtgtgcctttcatccagctttccacagggtggctacagaagtgggtgccgacaagtcctctaataaactgattgtcaatggctgcagactccgtgtaaaatggggacgattccaagcactcaaggggaaaaaaaaaaaaaaaaaacaaaaaaaaaaacaaaacaaaaaacaggttgcgggggacagaatcacagaatctgggatcctgccagagcctattccagtgccgccaggagctccttctccccctgcagctatggtgcctactttggagcctgcttacatggactgaggccaccttttctgacttttcccagtggcaaaatgcacctgacaaggagaatagacgtaggaacctggcctcctggaccctcacttgcccaggatttttcttggtgctgtgagctgaaggagttcttgtaagatggaagcagggccccaggatcatgtgattggcctcatgtctctgcctcactaatggtcaggtggtgggcactcagggcctgggaacccagccatccctgattccttgagttgatgaggcagggggctggcccacctgctcctgccccaccatggccgtcgtggatggttgctctttgagcctggtaacgtcactggcttggctctgccaggcatgcacaggccctgcgtacccacacactgctttaaggggcttgccctgccttgggccacagtctagttctggccagtgtcccaggaactcagtcccctgtgtatccatcttagctgtttctggggcacccatggctcccctgggtcctttttctcttagggctttggttggggagggcttgggctggatcgcagccccatggctctaggacgcttgccatgtgagagaggctctgtcacacgaatgggcagacatgaggacatgtgatatgctgctggctggctggggctgtgcagatgccacagtcactctcccctccagcagcctctgagggcccagcttccccattgatattgatcccatatggcctagcagtagtactgactgctttggggctgtgcaggtcactatcctcagagaaacgtcagatccagatgccaccatgcaaggggagtttctgtggtcctacctctgggttttcagtggggtgggccgggtctggttgttggagccctgctggggttgcagggatgggcctgtccattggtcctggcgatgtccagagcagatgtggaaggaataggagttcagcatgcctgctcaaagctgcactgtagaaaccatgagccctggatgtccaggtacatggggagttttgggagaggacacccacacagaaatcgcccaaaatcctggggtctgtcctgagataggaacagacttgctgcactctgggcggctgagcccccagagagtgtcctgctgcccggggctctgcagaagtcccctcatgctgctgggccttggcctcagggtcagcttctggacttctggagctgggctggtgggccacggagggccagcccatcccccttggggagggtctgcatgctgagggatgcccacagaggcctgggtgccagggacactcgctccaggcccaggaccttcctagggatctttgcgggtttggctgaaagaaaagcagatttggtccacttctccaccaagcccatttgttccttgcagggctgggcctcatgaacctgggcccctggagttttgggggtctctagtggcccacctggtgtgacactgaggaaacacccacaggctgctgaacccagagtgaggggtgcgtgcagcttggggcatggttgctgtcagagcatctcaggctgctcctgagacggaccccagggttcaggctggctcggggctccaggcctcataccctcaccccagggcggctcggtctgggcttcagccctggtgcagaacccagctgggagaggccttacctgtcacctggcccccttgccacctaagatgaggatctgtctccatagcgcgtgagacgctcctgggcactgggcccctctgccatcccggacaatccacgccatgccatgacttcccacaccaaggggcctactgcaccgtttccctgaatcctctctctgggtctgagacactgattctctccattccctggctcaaggcttgccgtcgtgacacacttggaggggtgcttgtgagtgaggcgcccctgctgttctctggcgttggtgctggcagctgtgggtgttggctcgcacagatgggaccaacccctccagtgccccctagggttcttctaggccaggaggggaagggtgtgggggaggggcttggaggggtcttgccctcatcccatgccctgtcactgaggcgagtctagcacctgccctggggcccagctggcctgttttcagaaacttctttgagaaggaagaggaaaaggaggaaggcccagggagtagggatggagggttctgggcactccccatgatttaatgcctcagagggtgactcgggaggctggagcccacgtgggatgcaggtcgcagtgtgtccttctcaactcgaccatggaggcctgagcaccacgtggtcctcaagagtccaggcctgagacagcatgtcctgaaggagctcccatgggccaaagagagacagcttcaggagatgttctaggaatggggctgcacatcaggccaggtggggtctcctgggagaggtctgtgccttcacctcgtttctgctctgggcacttcccagtgggcagtgctgggccccttttggacaaccctggggtccagctgtgcacaggaggccatggatgcagggaaggcccaggcaggggaatgctcaccacgctcctgcctttcatctgtgtcgtgtcaggggtgggctcagtttccagaaggactcacggtgccctgcacagctgaccaggcctggcttggcttggccttccctctaggccagagcagagggtcgtgtggacagtgcaagtgctgccctcaggacagttgaggtctgtcttgtgtggtcctcctgctaccttcaggcacatggggacaagtttctatgaactttgaatgccgcttatgtcctggctgtgagcttgtgctcgccctgcagaaggcagacctcccagagcctcaggatgagcccaaaaggggtctgtggggacagcaggcctgggaggacctggcctgtcaaggctgatggctggtggagtgagcagagcctattgggatcccagtctgtagtgccggggacccactctgcacagtatcagaccccccttcccaatgaggctatgtcagacaagatcctgcagatcctcatgggggtcgactcatctcagtgggatgtggcccctggaagaaggggctccccaagttctctcccaaggtgagtcctagcccagtctgcacacgatgccggctctgagccccagcccctgctgtgggatgtcggcatggtttctgtgccctgcagggacgtgcctctgcctcctgtgcagaggagacgagcaggatcattctggaggggtcagaaccctacagcggggaagccaggcactgtgggcagcagggtcactggactggggagggggggcggtctcctgtgcatccttgccccatcaattgagtgctgtgggaagcacattaaggtggcagtctgggtgcacaacatttccttgtcctcatggaaggagcagaggtgttcagagcccctaggacttccctgaaagcctccccgttcccgggccctctgcagtccctacccaatgccagaactccaggcagtaggctgggctgtcaccctcttctctgagacacctacctcgactcagagacctccccgatgcccttcagatggggaccctccataggccttatttgatgctgtagcgctcttggagcacgcatggtttctgaaggcgtggctcacgtccaggccattctggtgtacattcactgaggacagcttgccctgctccatcattttctgtagagcagggccaagagggggacccaccctcataacagacacaagactcactgccgaaacagctgtcataaaacagcagttctggaaggaaaagaggctttttctgcaaaaaacttctcctccttgtttccaaaggcagggaaagccatcagagcccagctcacctgtggagcccaggtcactatctatccgggatttgtgactggccccttccaccctctcaggactgactttccctccagctgggtaactgggcgcctgacatggcatggcatgtttgtcctgctctggccagttgtggtcgggccaaatgaggtatttccctaggttcctggccttccccttcttgaaaaccatcaggagtgaccacactggaccccagacttgtggggggattcccttgtagatccagtgagaaaaccatggacagaagaaggctttggtgagacaggtctcagggtgatagtaaggaggatcagagtctaagcattctggaagcctcctgcctttggctccaaggttcctcgggggaggtcgagtctacctaggaccgggccttccttccaatgaataaacagtggacaagtgctaaaaaagacaaacaaaaaaagagtgtaactgtgcattttaaaataacatgaacagtataattggattatttgcaactcagtggataaatgcttgagaggaggaatacctcaatctccatcatgtcctcatttcaaattgcaagctgcatcaaaacatgtcaagtatgtgtgcctactaaatacccataaaaatggacataaatgaaacgttaaaaaacaaataaacgacatatatagccgtatatcaattaaaggaattggattcagtaaaagcaacaaagaaactcaacaaagatatttctcaattaaacctcatgtttctggtgacttcactggataattctgccaaacgtttctgggagaaataacaccagttctccactcaagataattgaggagaggccacactttccaaagcattttacagagcaagcacaagcctgatatcaaaaccagacaacattatgagaaaataacatgacagaccaatgtaactcatgaacatagacacaaactctgtaaaaaacaattaaccggagttagaaactagcaacataaaaaatttacatcctagccaaatggaatttcctccatgtgagtttagcaaagtaacatggtacaagatgaacatggaaaagtcaatgctatttttatatgccagcaacaaacaattgaaaattgaaagtcgatatcccttaatatagcagcaaacccccccgtgaaatctgtagtggtaaaatttaacaaaatatgtgcaagacctgtgctcagaagcctaaaaaacatttcagaaaaatatgaaaccacgttgaaataaatagagagacataccacattaatggattgcaagactcaagattgtcaatatgtcagttactcccaaataatctatatgtctagtgtaaaccaataaaaatccctgcagcctcttgttgctataaaatgacaagctgacttcaaaatttatatgggaaagcaaagggactagaatagcctaacaattttataaaggaccaagaatattggaggactcacattacctgatatcgagatgcatttgacaactatgctaatcaggacactgtgatattggcagaagaaaaggcataagagtccgaagctagatctatatattcaagttaaatggatttttccataaagtgccaagagaattcagtggggaaggatgttttattccaggagtggtgctggaacagtcggacattgacatgcaaacaaatgaacctcaaactttgcctcacaccatacacaaaagttaactcaaaatgcttcatagaactaaatgtgaaagctaatgttacaacacttgtagaagaaaatgtaagggaatctgcagcatcgtgtaagataaagatagacaggatgcaaaaagcacaaactatgaaatagaacaaacatacatttttaaaattttatatactacaaacctgtcccttctataccttcacaaaggagaaagaagctttggagctgggaaagcagactattcccctgctctagtagttctcagacaagcttctgtgaaagttagagcccaagatctgttaaaagtgcagattccaggaatcacacccagtgaagcttatgtagtgtggccacaatggtgtcctaggatctgggaattcactgcccagcctagggaacttccagaaactttattaaatcccttaggtagcaagactgtctgaaatatatccactcttcccaggacagacatgaagttgagaagagcgacctcagagcacacagaaacacaggacatgatgaacacagtgtgaaaatcaccataagggtaaggcagtgcgtcttatgagaagacctcacaactcttactggcctttctccccagaggcctcagtttatctcaaatccctgctcctcatgggtggtgaatggagttgtgtcaggaaatgaccttttcgatccccaaaaggcatgggctcctttcaggggccactgaacacataggatggggcatgatgcaagctattgttcccctcccaccagccttggtttccttcttgcaccatcatgtgcttccacgggagcctagagcaatgacacgacttagggccaatgtcttccctttttaggagaccggcccctcgcctgagcagtgcgtctcccctctcctcctttcagctgtccttctcctgatctcatctgccattccacagcagacagctgtccctcgtagcctgatgatctagcctggccccttcctcctatgtcccagcctggagagggctgccctccccgagtggaaggacatcagtcccagggtcccagagccatgactactacagaaccatccttagcatcagtgtcccatggcagtggctgacctttgaaatgaagcttcaccacccatcgcagctggccctgaaacactttcttttctttttgtctcatttgagacaggccctcactgcgttgctcagcctgtagtgccgtggagaaatcatggctcacagtagccttgacctcccagactcaagcaatccttccatctcagcctcacaagtagctggaattacatgcatgctccaccatgcctgggtatatgcttttaaaattttttgtaaaacggggtctccctatgttgcccaggatggtcgtgaactctggggctgaaggaatcctcatgcctcgatgactcaacatgctgagatttgacgtctgagccaccttaccttgccgtgaaccattttctttcttttaaaattactattatactttaagttctgggatatgtgtgctgaacgtgtaggtttgttacacaggtatacacgtgccatgatggtttgctgcacccatcaagccgtcatctacattaggtatttctcctaatgctatccctcccatagacccccatcgcccaacaggccccagtgtgtgatgttcccctccctgtgtccacgtgttctcattgttcaactaccacttatgagtgagaacatggagtgtttggttttctgttcctgtgtcagtttgctgagaatgatggtttccaatttcatccatgtccctgcaaaggacatgaactcatcctttttcatggctgcatagtattccatggtgtatatgagccacattttctttatccagtctatcattgatgggcatttgggttggttccaagtctttgctattgtgaatagtgctgcaataaacatacgtgtgcatgtgtctttatagcagacacactgagtcaggcacaggcagggccgaccagggttttcctggtatccccacacccgaattccagggtgtttgtagtggaaacaaagggacgcgagagcttttgtgtgtgtgcttgtgtgtgtgtgtgtgtatgtgtgtctgtgtgtgtctgtgtttgtgtgtgtgtgtctgtctgtgtgtgtgtcttgtccaaccattctcctgcatccggaaacgttgggaacagagagtcccacgtcacccttagtgcggagtgtgtctcagaaagactttttgtgacagaaataaagaattttatgtctatatttacacatgcctttttctcagggtgtttttctgttgtgaagggtggagggcagtggcatgatcacgcctcactgcagcatccatcttctgggctcaagcaagcctcctcacactgaaacctcccaagtagctgggagtgcagatggccgccaccatgcccacctaatgtatttaattttttttttagatgaggtgtgtcagtgtgttgctcaggctgccttcaaacacacagcctcaagtgatcctcccatcttggccaatttttataaaggctttttatacatgctgtagactcaatcagttcacacttgtgtgcttttttaatattgtgttactccacctttgaacctgtcaactggtaactgatttccatgaaaacctgtaaggtgatcatggctcatcagtcagtgtgatttcagcgttgactcacagcagctaggaaagcctgcatgggaagtatgtcttgaggaaaactggagagtttccaggaacagttttgaaaaacagagactacttatgtcttccttccctcccttgcttctcctcatgtgccaggttttctgctttctccaattgttaacaaatcagcatggagtattatgtgatgaaacgcttttatctctttcatcatcccgtttcttcctcaaaactttttttttttttttctggaagggtggtaggcagaagggactaaacatattcagaaaaacacattgtaatataaatttcgtgaaaaaattcatcatatttaagaaatggtcaggatgaaatcctgaatttgtaataattgtaaaactcagtttgcataacctccaatccttttgtctctatcacttatccggtgagaagtgtagaaaagatgaattccttgcttgtgacagtggcattagttagtcaaactgctgcaccctgtccatcgatatcacacatccagatttaatagccacaaaatgcaaaggcattttacaactgtggcggttttctttatatcattgtaatttccattaaacccctagcactaaattcaatattcacacacttgcaagtaccatggccaagagagatcctgcctgaaatgttgagagggggctgcagcagtggcaacccggctgaagacgaggctggaatgtgtcttcacaaacctgcaaccccttttttgaggcagggtttctctcttttgcccaggctggagtacactggacgacttatagtgcaccacagcgtaggacttctgtgctcaagcgatcctcctgccttacgtttctgagtagatgggactacagacatgtgccacaatgcccaggtaattttaaaaattgtgtagagcaggggtctcactatgttgcccaagctggtcttgaactcctggcttcaagtgattctcctccctcagcctctcaaaatactgggattacaggcgtgagccactgcccgtggcctttttctcacttatttttcctttatctaagttttaaggtttatgtaaggctttgctccagcccaggaaactgaattttttccctcccacttggaggaaacagcaattcaaacgttcaggatttttgacctactgaaagttcattggcaacaattgtgtcctgtctctacctgcctgcaggagaaaacaaaaattaaagtcagcaccaggctgcacttttcctccatacattatcctgtgcagaacagcgtttgagggatccagtgagccagttctcttgcagttggagggattattgttaaatgctgggagtacatgtatttttcataacagacaacagctcggctgttgcttcatactatggggaaatgcatagtctcccaggagtgacagcttcatcatctctaccccttcactcttcctttactcaaagaaagctttcaccatattgtagtgagtcagggtcctgctggtgaatcacacggttgttgacactgtgtcagggacccccaaggccaccctcaccttcagtgattcatggacattctctgctgcccttctgcatacaatactcctaattgaagccagccccctcacctcaggtcagtataccatgcgtcccaccttgtcatgggctttgctcctgtagtgatcactcctctctcctgaaccatcgactgctccctctacattggatcattctccagctacgggaaaactcaccttcttcccccatgtccttctgtagctacgaacacatgtgtctgctgccctgcaaaggaaaactgcatgaacttatgcaacacacttcattggagtccattttcaaaattttctacaaaggaaaatgaaccagaatatctagaacaattctgaagtgtaacttgggggaattcaccccacacaatgtcaagattcacattaattctattttatttattgattgattatgttatcagtgagttggaagaagttgacttcccccttggcttgggggttgatccaatatagagggagccgttgatggttcaggggagaggaatgatcagtgcaggagcagaactcctgaaaaggtgggaggcatgggatcctcagctgaggtgagggtgctgccttgagttaggagcattgaatgaagctattgattatgatttttaatcatccagccccatatggcaattatgttacttctccagtattcaggacagtgtgatattgggggaaaatctacagatcaaaatagagtctagcaatagactcacaaacctaataagttgactttcagaaaagaggcaaaggcaatggacaaagattatcttttaaaaattgtgttattttctcctgcctcgtggccactacattaattgttttttattcctctggtttcctttcctgtgtttctcctttgcacttcaactgctgttctgtttgtctgtctgccccaccacagtgcgatatttcccacagcaaggaccaagtgtctttgtgatatttgctatgtccatctcatcaatgataaaccgaatcaagaaaatgtggtacacatgcaccatggaatactatgcagccatgaaatactatgcagccatgaaatgaatgagctcatgtccttggcagggaggtggatggtggtggcggccattatccttagcaaactaatgcaggaacagaaaaccaaataccggatgttctcacttataagtgggaggtaaatgatgaaaacacatggacacatgggagaaccatcactcactggggcgtactggagtgcgggggtgggaggagggagaggatcaggaagaacagctcacggatactgggcttaatatctgggtgatgtgatgatgtgtgcggtaaatcaccgtggcacacatttacttgtgtaagaaacctgcacatccttcacatgtacccctgaacttaaagtaaaatttggaaattaaaaaaaagtcaatatctcagaatccttatttctatgttttggtctttgtgtcatttatctaagcattatggtgacatgaaagctgaggcataacaacagttagtatgattagcaatttagcaggattatagctcagtatgatataacatcaactactagtattgaattgcattcaactccttgaagtgcttaaggaaagttggtaagaaaaagtattcacacttgaaaacatttttaaaattcatgtaaactggatcaacactgattaccacagatgtcactgtcactagatgctaatgaattacataatagtaaccataaaacccagtcaaaaataaagggggaaataaaaggagacatatcaaagcatcatcagatgaatgcaggaacacccacatgaacacaccctgcagttaaactgacaatttaaacatcactgagtgctatttcaagcattatgtagaaagctacagacaacagtgaacttattctgagcacgtcttaatccatcatcttcacagatggctatagaaatggcctgtaaacattttgtctgataaccgctaaagtagtgacgttcaaactcttttatgacaatgtgtgagaaacgcacagtttatatatagtcgactaggcaaataaatatatatatgtgcttggggatgtgcagtgaatattgtatatttgtatattctgtgtgcagtgaatgctacttagtaatttattttatctccgttctttaaaatgctgtttttggctgacaacattaatcttatgatcgaccatggattaaaaaccagtttagaaatgattaaagccttttcagagaacatcttgaatggttgataaatgttgctatagtatatatccaaaaacacattagaacccaattttgtccgcctccttagcaattcagtgtttttagacaaaaatgtcgtctttgatatgggccacaaaagccactacaaaatagacaattactgatgaaatgtgtgtttcatctgcagatatctgtttctcttttgcaaaggtgaagtcttacttggacagatgggaactcacaggcaaaaagggacagaaagtacatatgacctcttgtcctcttggtatcacgtggaggctttgcttgggctgcagcatacgtgaatgttatgcatttcctgcattcatggagacctccctgtgagtgcacagggacctccattcccctacggtggtcccattttatgaggcaagtgggagaatggcacggaacatggtaggtagtaaataatttggcctcaaccacaaagcaatctgagctcacatgacagtgtttactctggtaccctgaaacttgccagctgctcagaatctgtagactttgtcccacccacccaccatcctgtggaaatctatgtttggtcatagattcccatgcgtggaggatgggaagctctggtcatgtgggaaattgagccctctcacaggtagactggctgtgttggtcccagctctgtttcctcccttagcagctagagagttgctagggtcatgtatcaggcaactcttcttgtctctgcagtgtctttcatactgtctgctgcttcctgtttgtcacaagggctccttcacaactttcccaataccaatgcaattatgatcctttgaagttatccaggaggtccggagttatagtccacaggaagggcagcgggaagttcaaatttggcaagaaattcaagcctgccctttgaagctggagtgaggccactcaggaatcattaaagtccaggtctgcaggtgatgtttaatattaagtgtcaacttggttggatcaaagggtgcaaagtattgttcctgggtgtgtctgagacgttgttgccaaaggagattaacatttgagtcagtggactgggagaggtagacccaccctcaatctgggtgggcaccgtctaatcatttgccagtgccactagaataaaccaggcagaagaacatggaaaaccagacttgctgagtcttccagcctccaactttctcccgtgctgcatgcctcctgtcctcaaacatcagactccaggttcctctgcttttggactcttgaacttacactggtgatctgccaggggctctcaggctttcagccacagactaaaggctgcaatgctggcttcaatacgtttgaggttttggaactcagactgcctttcttgctcctcagcttgcagacagcctattttgggacttcgccttgtgattgtgtaaatcaatattccttgataagccctgcttcacatatacatctatgcatcagttctgtccttctgcagatccgtaactaatacagtgtgaaagagtaccatccagccatctgatggcatgaccatttgctaaatagttgcccacagaaagtctgagtccagaaatcactatttcctattctttgagcacgtctgagtgcactatattaaaaactggggttaataagaaacaaaataaagtaaaatttaataatgatagtgcccttgccaagaaagaataaaaagataaaagttaaattaattaagtcatcatgattacaactgctctcaccttttaaaaaaatctttgaaacgccgtaattcctactcacattgcttttgagagagagacagagagactgagcaaacttttatttccaactcaaggtatttccctaagagaagcccaggtgaatggaatatataggagtcatttcagcaatatatctcaatttatttataaaagcctgcattctcatcaggccccccttcctatccttctgtttcatatactatttcccacattaaactgctaagtaatacaaaagtaataaaaacaggaatcatgcacacagcttactgtctactttaaggaaagtttatacaccactggcttcattaagataactttactaatacaggaatctcttgcttaggaaaataaaagttgcaaagaactttactgttaatttcagcaactgtctgaaagatccatcaagtcttcagtcaaaagattcaaatgacatttttcaaccccaaaacacattgaatcattgcctaaaagtgtttgtcttcttggctccaccagtcctaaatcattatgattcctatctaactccaaacaaacagtcccccactttaaaagacccactttacaccagatttcaaaatgagaataaagatacttaaatcccctcgtctgacatactagtgctttgttgaagtagtgctctcttttacagcgttatgcaaataatatcagccctgtcttacgaacaggccatgtggctgatatttggagagtacggtatatgatctggttagtcaccactgcatgacatcatgtcacagtagactgtgcctagatcctgtcatcaatatctatgtatatttctgaatatacatatacggtctgaatgacctacaagtatattcaggcaaatcagtcaccagtccagagatgtaaatgttcaataacacacctccccataaatttagcacgtgtgaatatatttagtctgcagaagagtttattccattacattcattagaagcatggcagaaaactgagaaccagaggaaaaaagtgaattatcaaagcacgtataaaaattggtcaaggtaggaggatcgcttgagcccaggaattcgagaccaacatggaaacggagtgagaccatgctctaaaaaatgaatttactgcccacgtgtggtgtttgcacctgtagtaccacccacttgagaggctgcagcatgaggattatttgagcccaggagatccagacttcagtgagttatgatcatgccactgccatccagcctgggtgagaaagtgacaccctgtctaaaaaaaaaaaaaaaaaaaaaaaaaaaaaaaaaaaaaacatttataaataaggatataaaaatagtttatttcacaacaggcttttctgaaacacgtcctccattaagggtgacataggactgtgtgttcccaatgtttctcaatgcatgagattgtttgggcaaagaaaaagaaaagctcccttaagtccctttctttccactacaaacaacttgtgggtgcgggtatgagaacagcaggaaaaccacggtcggccctgcaagtagcagactcaatgggcatgccccttgctaagcaagttcctgctgcccatgtgccttgctgtctgctttctgtccctgcagagctgtggaaggaaacgttgtgacttctttcttgcctactatgacacaacacgtaggtcccagatcagtcctcccagaagttgaagtgtcagtgagtgtgagggagagcggaagggcttcctgtgggttggaccactcggtctatggcctcatagaggtcgtcatccttctactaaaagacagtggcatcaccatggccttgatgttgtggggtcctggagaggggaggagttaaggccgtagaggcgaggagggtcagatgatcaaggaatgaattgaagcgtgacattatttgcggtatttcagtctccgaagcataagaaaccacagaggatgggttccaacatccttagtggggaccttggaagaagcagaggacagtgagtgcaggaacaaggaggtgcagtgcagccctttaaggcaagaggggaactcactgcgcacgctccttgggtgcccgcctcagtgcacaggttcactgggcgtcttcccatctgcctttttgcccacgtggtgagtgccttagagctgtgagcctgcagctcggtccctgagatctgcattctttctcccctactgagacgcagccggtaagtccgcaggcccctcctactgggaattgaagtgtgagtgagagtgaggaggagacactggggttccagagggtcgggcagcttggtcggtgactctgagggagaagggctttgatgttgtcgtccttctcatgtggccctgccactatgggccttcttgtcttgctggagtgcgaacgaaagaagaaggagggcctcggagtggggcgatgctggggtgctgctggcggtattcgagtcccagaaacccctggaacccccaacagaggacagattctgaactcctcaaggaggatcagggctgggaggtgtgggcggtaaggaaagggcctgcaaagtgggaacactccagactggttcccgccaccccaaggtttgtgtagtgactcccagtggcgcccgacctgtgaggaccgcccagtgctgtgtggcaagttttcaacttcatcttggacgttcgaatgcgcggacggggctctgcattccaacaaaactcgattttgtgggggaaatgggcctagcaaatgggtgcgtgacaaaagctgtggacactttaatttgaattctcaagctgtattttcctaagtgtctcaccatggagagtccagttgtgaaaccaaacctcattggaaatactgtgtgtctcttgccctaagccctaaggcattgctcagctcagtaaagccctaaggcattacttgacgaacgtaagtggctgtgcaagtattcgattcagaaggcatacacacttatacatgctctctgacttacttttcaatgtcttaccaaacttttataaattgcaagttaacatttggccatggacgtagtatcctctcacgtgcatttttccaatcacagttttctaatttttgctttgttttgttttgatttggtttggtttttttgagagggagttttgctcttgttgcccaggctggagtgcaatgacatgatctcggctggctgcaacctttgcccctgggttctatcgattctcctgcctcagcctcccaactagctgggattacaggtacctgctaccacgcccagctaagtttttgtatttttggtagagatggggtttcactattttggccaagctggcctcgaactcctgacctcaggtggtccacccaccttggcctcccaaagtgcacactattctgtttgcagactgaaatatgagttggcgaggaagatgatatagaaccaagatgatgtttacgacttgctcagctgattgggcctatgcttgtgagtgacttaacattcaatgttttctattagcagaatttttttgtgtgtgatagtgttgttgaactagcatagatgcactgataaaggtctcccatgttgacaaaaaaccattgcggcatctcatgaaggaaacagtaacccaagaggactacatactggttttgcctggatgtgggaatttgtgttccccagatttgactagtgatttcctcctcatgcttattcatagctcattacactagcacatagctagtgttgcagcatgtctttaaacatgcatatgatcagaagtatctatgtaatctgtatattcgtgttattgacatgcattgataagaaaaattttttatctgcacatgcacacagaaaacccccttttcccaggagcctagtgtgccagagcctcaacaagaagaaccaccagctgaaagtcaggatagtacatctggtcagaagacagaagaagatcagggtgcagctgagattcaaagtggtgggaagagaaagaaagaatgtctacggggggaggaggcctatgtgtgcatcatgccttatgccatgaccagtaagaggaggaaagaaaacactaggaaaggatctcaaacatttgctgagggttggctggaaacgtgacgggtatagtttgcagcttcctgcagtccctggatatgattaatcttctctttttcttcgagatgcattttgtaggcttgaaagtacagtccttcctaaatcagatgaaatcatttaattggttgtataaaaatgtacattatttcactagtttaacttgatattcttaggatgttgcagtgagatcttctcagccatggtattcacagtgttttaagcaccctttaatagcatgtggagtgccaagtcgccctaccttataataccctgaataaagcccatttgcaaagggatgttaacctcattttataaataaaactgaggcccggtgtggtggctcatgcctgtaatccctgcactttgggaggccgaagcgggcagatcacttgaggtcaggagttcaagaccagcctggccaatatggtgaaaccccatctctactaaaaatacaaaaattagctgggcatggtggcacacactcgtaatcccagatgctaagcaggctgaggcaggagagtcacttgagcccgggtggcattggttgcagtgagccaagatcgcaccactgcactccaacctcggtgacacagcgagactctgtctccaaaaataaaaataaaaataaataaataaataagaaaactgagaatcagaggttgagacttaccaagaacacttggctcatggagaaggaattcatattttgttccaaggtttgcattctattttagaaaatgtgaatgattttgcttaaaaatgcttaatattcaaatgtgtctgtactataaggtaatttggtatcggctcagggcaaaacgcagttcagtgaagcaagatagcaactccagaaaggaggccaataaatgacagccactgtttcctttgatttatatttttgaacgtatgtttgataaaagctggataattcaggacaatggcatacaggtaactgtatttgtaggattttgaaggggcttttaaaagttgttgcaatatttttataattagaaaattctaagtatgataagattatcatgaaacagaaactgtttcctcaacagatagcattttcaaactaatcagagacagaatttgggccatgggttattttggcaattccctgttaaggggtttccagaatatgactgtcaacaatgcccattaatttatttgcacttcagttcccatactctcactggaagacagtgattttgcttttatattccgtacttttttcttaatgacattcatgtatggaaagtcacatatagcgccttttgacctaagaataactttgattaagtttaaccccaacattttcaagatacctcaacaggagatgagtatcaggactataggatttgtcataagctcaccaatacattgatctaatccttcagaaaattacatttaagttatgattaaaatgctatccacgaggccatcttcaggtttcctaggtagctgtgtgtttataatacacaatggtaaagtatgggaaatgcaggtgtgctgtgacttatcctcagattgtcatttaagataagatatcataatacaggaaaacaaacggggacatctttgcatcacatttattaccacagtagcctctaggcttttattgcatcacactgaggaaaagaacaggatcatttccttatttatcattctgctttggctgctccagttgatttccttggtattttttagtgcctgacctggaagctgatctccaggagctgtctcagtcaaagactggggatgaatgcggagatgatcctgatatccaggggaagattctgccaaaatcagagcaatttaaaatgccagaaggaggtatgttatccattaagattcaaaattacgtgctttctgtattccacaatattacacttttgacaataaaaagagagaatattactgcccctccaaaaactgagttcaaatgcagactttcttcgaaaggtagatcagaccctagaagcctgactgcaaaactgaaacactatcagatacagacacaaattgggtcaaagccatattgaaccattgaatagcaaagcattttgttacttctaagtataaccaacagctaacaattttcagattattttgcaatttctgtttctcacaaataaataatgcatttgtaataccactttgtatgatatatgctgatccctgaaggagattctagtaccagctccaacataatttgtgagattctggacaaatcacatcaatcctacacccatttttgcttttattgaaaatagtgaatgcacataagatacattaaaatccatttcagtgctggtttctccatgctttcgtcttgttgcagagaatatacagatattctgattttcatgatttgtttatcataacaatcagctttagtccaattaaaatatctgagttgagacttcattgctcctaagaaaatgagaaggcactctgcttgatgcttgttttcctgtatggagaccttcatgagtgttcttggattttgtcaaatcctgaattctctcaggctcttaaacaatgattgcatttttttttcagatggggtctcactctgtcacccaggatggagtgcagtgttctgatctcggttcactgcgacttctgcctcccgggttcaagcgattctcaagcctcagcctcccatgcatttgggattacagatgcctgccaccatgccaaccaatttttttatttttagtagagacgaggtttcaccatgttggccaggctgggctcgaactcctgacctcaagtgacccactcgtctcggcctcccaaaatgttgggagtgattataggggtgaacctcctcctgcgccagacccaatgattacattttaatgtcttcccgcagtgaagccttgaatgactgagtaataaaatcgatagagacagtcaggtttttgtgacccatgaagtagggagaatgcatgtaggtcagtcatgctcaaggtggttgtaagatgcctgtgctaagcatgctccctgtcctcctgtcagtcttcatgagctactgtgtgtaattagattgaagacacatatggtaaccgctaaccatatcagaggttatattacaggcttctgctttgagtcatcagatgatatgatttagagttcaaagtctataatgtactaagtcctgagtagtccacataagtatttttcatacatgttttccaaattgctgacttaattagaagaacttctgaatttaaaggaagcactgcacgtataggggagaatatctaaatgtttttacttcacactgctgaaccactccctttgactatttacattaaaggatagcttgtaggcgatttccaggagcctattgaacaagcctgaatagtattcttaggacagtcatagcattatatgcatatcctattaaaatagacagcaaattacatgatacaagaaaataatactaagaaataaaaaaagagtcacaaaagaaacttaagggaaagggaaacaggcagtaaatgaaaggtacgaatcattaacaaaaggaaaactaatccaaaagtaataaatttaacagatcgttcttttgtgaaatatctaggaagagagcatccagtagcttaaacaatcttgaggaaaatggaaaaagcacaacacggaatatgaacaagacacagatattgaatataaggcatgattgaaagggaatacattcttgaacactaatattttcagagtgtggatgaaatggttgacatgctaggaacacctacattatttaacgtatccctttaatacctgaatatctgaacatcacaaagactgtgcatgagcttgtggaatttgctggtcatccctcaaaacagttacttttagaagcaaatatttagcttttccagatgccttactctccgttttcttttccccctccattttttttttgccacactggttatgatgtataactctttcacgttttaatgtcaataaagatcctgataccttaaaacttatatgaccatttaattaattatataaacgggaatacattctggtgattaaagtgtcattattcatatcctcatgaggactataggtgaaaactggatgcaaatgtttactttatgttaaaaaaaaacacagaagggtaacctagcccaaaggaatattgctgcacttcagcacaatagagaaaaaacaaatgcaatactggccttcctattcatttcacttatgtatttcctaatgtgacattaactgttttctccaaagataattttcagactttttgcaggagcttattggacatcaagaccatagtttcaagccaacacattaaattatacatttttcacaaattccttctgttgcttaggttttttatgtcctggtcgtattttgagtaaaactctacaaaatgtttgctatctactctaagcaccttttaaataggtccacttgatttaatgtgttctgacctcagactgtcttttggtttccttctagcactaaaagaagggtgtgtttaaaaaatgttactaatatgtacccttggaagtgtatcttcaaagtctctacagaggtttagttgaatgttagccatagggatgctgaagcacgaggatgtcttgagcttgggagactgagacatgcttgggcaacctgctgaaaccccctgtctacaaaaataaatgaatgaatgcatgaatgtatgcatgtatgtatgcaggtgtagtcccagctactctaaatgaatgtatgcatgtaatgcaggtgtatactccagctactctggaggctgaggtgagaggttcccttgagcctaggaggttgaggatgcaggtagacattttcatgccactgcaactccagcccgggtgactgagactgttttaataaaaaatagtatcatttttggaagatggccaaataggaacagctccaatctgcagctcccagtgagatcgatgcagaagacgggtgattcctgcatttccaactgaggtacctggttcatctcattgggactggttggacagtgggtgcagtccacggagggtgagctgaagcagggcggggcgtggactcacccgggaagtgcaaggggtcaggggatttccctttgctagccaagggaagccatgacagtctgtacctgcgcttttcccacagtcttcacaaccggcagaccaggagattccctcctgtgcctggctcagagggtcccatgcccatggagccttgctcactgctcccacagcagtctgagatcgacctgtgatgctgcagcttggcgaagggaggggcgtccgccattgctgaggcttgagtaggtgattctgtgctcacagtgtaaataaggaggctcggaagcttgaactgggcggacccactgcagcttagcaaggcctactgcctctctagattccacctctgtgggcagggcatatcagaacaaaaggcagcagtcagcttccacaaacctaaacatccctgtctgacagctctgaagagagcagtggttctcccagcatggcattcgagctctgagaacagacagactgccacctcaagtgggtccctgaccatcatgtagcctgactgggaacccccagtaggggccgacagacagctcatacaagcaggtgcccctctgggacgaatcttccagaggaaggatcaggcagcaatatttgctgttctgcagcctccgctggtgatacctaggcaaacaggttctggagtggaactccagcaaactccaacagacctgcagctgaggggcccgactgttagaaggaaaactaacaaacagaaaggaatagcatcaacatcaacaaaaagcacatccacaccaaaaccccatctgtaggtcaccaacatcaaagaccaaagatagataaaaccacatagatggggacaaaccagagcagaaaatctgaaaactcaaaaaccagagcccctcttctcctccaaaggatcgcagctcctcgccagcaaaggaacaaaactggacggagaatgagtttgatgagttgacagaagaaggcttcaaaaggtcagtaataacaaacttcaccaaactaatggagcatattctaacccatcacaaggaagctaaaaaccttgaaaaaagattagacgactggctaactagaataaacactgttgagaagaccttaaatgaccggatggatctgaaaaccacagcacgagaacttcatgatgcatgcacaagcttcaatagcagatttgatcaagtggaagaaaggatatcagtgactgaagatcaaattaatgaaataaagagagaagacaagattagagaaaaaagagtgaaaagaacaaagcctgcaagaaatatgggactatgtgaaaagaccgaatctacgtttgattggtgtgactgaatgtgatggggagaatggaaccaagttagaaaacactcttcagaatattatccaggagaacttccccaacctagcaaggcaggccaacattcaaattcaggaaatacagagaacaccacaaagatactcctcgagaagagcaaccccaagacatataattgtcagattcaccaaggttgaaatcaaggaaaaaatgttaagggcagccagagagaaaggttgggttacccacagagagaagcccaacagactaacagcagatctcttggcagcaaccatacaagccagaagagagtgggggccaatattcaacattcttaaagcaaagaattttcaacccagaatttcatatccagtgaaactaagattcataagtgtagggaaaagaaaatcctttacagacaagcaaatgctgagagattttgtcaccaccaggcctgccttacaacagctcctgaaggaagcactaaacatgggaaggaacaaccggtaccagccactacaaaaatataccaaattgtaaagaccatcgacgctatgaagaaactgcatcaattaacaggcaaaacaaccagctaacatcacattgacagcatcaaattcacacataagaatattaaccttaaatgtgagtgggctaaatgccccaattaaaagacacagactggcaaattgaataacagtgaagacccatcggtgtgctgtattcaagggatggaggaagatctaccaagaaaacggaaaccaaaaaaaaaaaaaaagcaggggttgcaatcgtagtctctggtaaaacagactttaaaccaacaaagatcaacagagacaaagaaggccattacataatggtaaagagatcaattcaaccagaagagctaactatcctaaatatatatacacccaacacaggagcacccagattcataaaggaagtccttagaggcctacaaagagacttagactccctaaaaaaaattttggaggaatatgaaagcacgctgaaataagtggagagacataccacgttaaaggatcccaagacttaagattgtcaatatgtcagtttctcccaaataatctgtacattccatgtaaacccaattaaaatacttgcaaactcttgtttctataaattgacaagctgacttcaaaatttatatgggaaagcaaagggactagaatagcctaacaatgttataaagggcaaataatattggagtattcacattatctgatttcaagatgcatttgacaactatgctaatcaggacactgtgatattggcagaggaaaaggcataagagtctgaagctagatctatatatgcaagttaaatagatttttccataaagtgccaagataattcagtggggaaggatgttttattccaggaatggtgctggaacaattggacattgatatgcaaaaaaatgaaccttaatctttgcctcacgccatatacaaaaatgaactcaaaatacatcatagaactcaatgtaaaagctactgttacaacacttgtagaagaaaatgtaagggaatctgcagcatcttgtaagacaaagatagacaggatacaaaaagcactaactatgaaatagtacatgcatacatttttaaaattctatataattatgtgctaccctcatccagtgactacttacttgcccaagaattatacaaatgatatgaagaggtaattagagctctaatttcctagaaagttttcattcaaattctccataccagctcatgaagacaaaaccccagctttaaatttaggctttagaataaccccatgaggagcattgattattcattattctaaaaaaaatgtgccctccttccagccacacagactcatttcttgagtcccaaaagagctgaagtgataacagaaagatcatccaaggggtcaaaggtattcatgacatagtctctctggaacatgtcccagggaaatgtggacacagcaacaatcttggcaacaataacagctagaattgattggaaatttatgatatggctggcaatgtcctgacaactgtgcatgtcttaatacactcaatgctctaaactgccccaagaaatagatgacattactagtagtatttccatgatactaatggagaaaggaggcacagagatgataaggaactgtctcagtgtcacccagcagtgagtggtggagccaaaggccacaggcatggtgaaaactctactgagctgcatatttgtgtaatcaagagtaagatccaaaggctactgcaaaactttagaatgttagagcatgaaactgcacaggcaaaagacatttgatttcttcagaaatctttaagagatggagacttgaaaggactggtctgggtatcatttggagacggcatcctgagagtgtcattagaataacagccagcatgtgagtgtccgtctcctcacctgaaggtcttgagttcgtccatcagagaaggcaccaaacctgtcccttctatacttttacaaaggagacagaagccgtgtagctgggaaatgagactattcccctgctctaatagttctcagacaagtttccatgaaagttagaatccaagatctgttaaaagtgcagattccaggaatcacacccagtgaagctcatttagtgtggccacaactgtgtcctaggatctgggaatttactccccagcctagggaactttcagaaaccttattaaatccctcaggtaacaagactctctgcaatatacccagaaaaatattcccaggacagacatgaggttgagaagagcgacctcaacacacaggaacacaggacaggatgaacgcagtgtgagactcatcataagggtaaggcagtgtatcttatgagaagacctcacaactcttactggcctttctccccagaggcctgtttatctcaaatccctgctcctcgtgggtggtgaatggagttgtgtcaggaaatgaccttttagatcccagaaaggcatgggctcctctcaggggccactgaacacataggatggggcgtgatgcaagctgttgttcccctcccaccagccttggtttccttcttgcaccatcatgtgcttccacgggagcctagagcaatgacacgacttagggccaatgtcttccctttttaggagaccggcccctcacctgaggagtgcgtctccccctctcttcctttcagctgtccttctcctgatctcatctgccatcccacagcagacaggtgtccctggtagcctgacgacctagcctggccccttcctcctgtgtccccacctggagagggctgtcctcgccaaggggaaggacactgatccaaggatcccagagacatgcctaccacagaaccatcctgagcatcaatgtcccatggcagtgcttgacctatgaaatgaagcttcaccacacaccccagctggccgtgaaatattttctttctttttgtcttatttgagacagggtctcactgtgttgctcagcctggaatgtaatagagaaattgtggctcactgtagccttgaattcccagactccagcaatccttccatctcatcctcatataccatgcacaggccaccatgcctaggtatatatttttaacttttttgtaaagatggggtcaccctctgttgtcctggctggtcttgaaccccagagcttaaagaatactcacacttcgatgaaccaacatgctgagatttgaggtctgagccacctcaccttgccatgaaccattttcttatcacggaaagcaagacagaggaggaaggtgcctgcaactcctcctggggaacattgtgtccttccccttgttactgagctgtttcctctgtactgactgcaacattgctatgcttttgatgtaaataagaagtttgagggtactcctttgcattcctaaacttgcggtttatagccagaacatcattgcccattttggggcattttggaaatttctgagggtagctgtggttgttggaattattgtcagaggttactggcatttggggattaaggttatggggagaggcaaagttttttttcctgagtcttaaataaactggattttccatacatgtcacttccctgtaaactgagggagacttatatgttgctttatctgggaacttatgaagacttgttgactgctttggaaaatcacatcactgcagggcatttcattcttggattccactctgatacaacattccaatatcagtttgctttgcacctgtgcatgcctgggaaaaatagaatgagggaaatccagcttgtctaccaacagtatcttttccaagataagctgtcaattgttggggaaaatgaagtgggagatgttcacagtgtaatttcccttgagttggtgaaaacaccagctatgccccttgctgttactgcactgaaagttctctttgcagatgtatctctctcactaggttcccaggtcctttgtgaaaggttgaaattttacccagtagacccctatgtctttgggatggaacagaggacctcacaggcagatggagggcagggaacacttgtggaattgtagtgatctctacatggttggatgatcaaaccctaaggcacagtgatgagccacgtggatgtcagtctgcagagggtgggaggggaatgccacaggcctctgccttaggagccatgcatcagagtgataccagcctgcagtactgatctcagttatgccctttaagggtcccagatgtaagcagcctattggttggggtttctctgtttgtgtgggtgttgaggggagtgagtggagagatagagagaaagagaggagattttgagaaactgtctcaggcaactatgggagctggaaagtacaaactttgcagagcaggatgtcaccctggagtcccctggcagaggtgatgtgatagctcaaatttaagcgcagtgtggaggcagatgtttttcatcttatggagggccccagtctttttctttgaaggcctccaagtgactggatgaggctcaaacacattgtggaggacaattagcttttctcaaagtctgttgatttaagtgttagtctcatatcagaacaccccttcagagagacagctacattgattaaagtgaagaatttcctacgtagtgtggcccagcaaagttgacacatcaaatttcccatcatagctgtcttgcacaaaagctattaatgatgaatgtctatcttagataggcaggggacttcctaactaagattctgtattaaccacttttgtccggtccaagccaccatttcaggctcagctcaactctggccagtaagctgtagctgccatgaatgccttccagggcccaggcagggtccggatagtcgggggacacatgcaagcacattgccagagggcacacgtgatacccctggacaccaagagtttacccttgtgagagcacccctccgggacatacattagtcaggcagaagttggccaaggccccaacatggcatccttctgtaagacctttcctctagggttcctcatccagtccaaacaatgcatctgcatctttggcttaggggaactgtcagaaggcagtcagttcagcatagtcattgacaccagttcctcatcttcacaagcatgaatgacttccataggtcttctgtgttcaggagctggattgcccctcctgtcccggctgatgttgcagctctgtcaggtgtgatcctaagctgagtattcagtgcggtttcaccattggtcttagggtacagctgtaggttcctcacagaaaaagagactctccatctatgctgtctgtcattgagtacctctgattcactgtcatactgtgggactagggacatggtgctgacacaatggtgatcttgcttttgctgcgtctgcaagcaatcagtcaattggatccatttgagctcactgtcttcttaccggacaaatctatggatatgtgacaagccagactaacaaccgtattggtgatccctgtggccctgttagccaccacagggctgcttaggtactgcctgagcaattgacacacaattgtactgaattatgtggtgttgcccaatcagaatgttgacttattcctcatggcatcacacagagcaaggagcaaagttttcagcacatactactgacaggattttccttgtcacagttgggtatttacaaaaatatttcagaattcattccatgtgtgacaccattaatgaacatgtatatttaaatcaaataagctatggaagtcaaatgcatttaaaaaggtaacttcgtatttttacttgcatttcacaaaggtagctatcacttaatatagatgtagttgtaaaggcaaatcaagtgaaaagattaaattttaaagaaaaaaataaataacttgtaaaccaaatttatgtgcactgtaatgccttctcggtatgttacttcttttattcttcataacaatcatttagtgtaaataatctcatttctaatttagaaatggggaaacagtcccacaggatataagtactttgctcatcatctcaagccagtgtgtcagggccatgatggaaactcatgggtattccatgttatagtctgtgaggagacagtgtagctgggacccaagtcattttgctcagcaagttgccctggttactttcccctttcttctactaggccctaattctttcattcagctctacagcctaggaacttctcacatactttgtggcgaatgggatcccctacatttagactcactttttatttgaaccctagcttttcagtccttttgaacaaaaatatttataatctctgtaaaagagagaaatcattgctaattataatgcccttgccctctctaagcagtgtggattttgagaaggggcctttactgcagaattatcttttatggtgtgaggatacaaatggagctcagaggtgtcagtcgtgtattatgtattagtaagagggatatcaggctggatccaggcagctgcaggggctcctgaatgagatgtggtgactgtgaggctgatggattttatgtagatgaaaaatgaggtttggtgcttctccttccctgactcttaataattttaaagaaaggtcggacgtgtttgcatgagatgttgtggacttgctccacagggattgagacatcatttcttctctccgtgtttccactcactgtttcagatggctttagtattctagttacatgtttctgtaccacagtaaaataggtgtgttctcattaattttttaaaaatgtttttggaccggtcgggcgctatgtgactcctaaatgtaatcgcagcaatttgggaggctgaggtggtctgatcacctgaggtcaggggttcaacaccagcctggtaaacaaggtgaaactccatctctacaaaaatacaaaaattagccagatgtgggtgcatgcgactgtaatcccacccaatcgggaggctgaggtgtgagaattgcttgaaccagggaggcagaggttgcagtgagccaagatggcaccattgcactccagcccagtgacagagtgagactgcatctcaaaaaaagaaaaaaaaagtttttggaccaatggtttcatctagggatgcctgttaggcctatgtgccatgttttgggaaacccctccttcaagagaagaacaaagcctcttatcttgaataatgaaaaaatatattttatatattatcctagatttatatgaaatcatgtgattaccacgaaagtcaacatgtacaacaccagttctacgttcaacactgtcagaagcatttgcttcaagaaagcgcagactgtgaacttagaacttgagtccccatatctgcttcttactagagtcatttattgttaattttaggaaactctgactcaccttattaaagaattaaatgaggtcagaatcaatgaaacatagctcacagaattggctaatggataacacatactctataaatgtgaggtattattattcctgtttttcttagagaacccattttataagcctccagagtagctgggactacagtgacatacagacatgagtacattcatacaatcattcatttatttttgcaggggggggtctcgctgtgttgctcaatctggtgtcagtctctgagctcaagcagtccacctccctcagcatgccaaaatactggattacagacatgagccactgcacctggccacaagttacaaaagtgttaactacctgggaataaaatgaataaaaaatgtgcaagaattctttggagaaggcttaaaactttattgagacatttttcagtcaaatatctaatataaaaccagtttgtgttgtttcagcttgtcttcatttaaaactgtggttgcccatcacctataatagaaacataacaggaggggacattactagcagaactgtattcagataaaattaaaggtatgagaaggacaccgaagttttagttttacacaatggactaaaactaggagcctaagagtcactctatggcttatattgaattagacttctgtagagacgtaatatgtctgtattctctgtagagagtacatttattacttatgaataacttcaactaatgattcatacctgtcttttattcactacctgtctccccataagtttgttctgtggctcttctactattatgtttatttctttgtattatttttatttgtcatgtaattttctgtctattttagtaacatgtgcatttaaggctatgatcttcctaagaatacaattgaggcttgttcgatatgcttccagaaatcgtctgaaaactatcttttaatgtaaatagtctaatgaaatggttcagcagtgtagagtaaaaacatttaggtaatttctcccctaaacatgcagttcttcagttaaaatcagaaagtcttctaattcatagccatcaattggcattatatgcgtaaaaaatacttatgtcaactacccaggaattagtacccttagaatacttgaaatttaattcctatcatctgaggtctcaaggcagaaacctgtaaaatgtaacctatgatatggttggaagagattgtatcatacgtgtcttctatctaattgcacacagtaggtcatgaagactgacaggagggcagagagcatgcttagcacaggcatcttacacctaccttgagcatcactgacctacgtgcattctctctacttatcagccacagaaataagactgtcacttgccattttattataacggtttcttctgatttagcaaggacagtattttcaacatagaaaatgtatctcaaaggtaagagatgattcattatatccagggactccaggaaactacaaactatacttatcaattttccagccaactttcagcaaacatttgagaccctttcctaatgctttctttcctcctgttactgctcaaggcataaggcatgatgcacacataggcctcctccccccatagacattctttctttcccttcccaggaccttgaatctcagctgcaccttgatcattcttctctctcctgaccaggttttggatcttgactttcagctggtggttcctcctctcatggctctttatcactgggctcctgggaacaggggtgtgtgtttgtccagataaaaagttttgttatcaattacatgtcaataatataaatgtatataatacatacatattgttgatcataagtacgtctgaagacatttctccaacactataccatatactaattgttcatagagttactcttttcacagacaggttactctaatagagttaacctcaagggcttcagaagccattttaatttatgttgggatgaatgtgtggaatcatgggatactttaatcattgtacctatactagttcaacactatcatgaaaaggaatttctgctaatggaaagcattgaatggcaaggcactcacaagcataggcccaatcagctcaggaggttgtacatatcatcttggtctaggcctatatgttgatcttcctagccaattcatatttcacagtgcgaacaggaaactgtgatggggaaaatgcacttgacaggatagctatatttgaccacttccatagccaaatttcaacttgtaattttttaaaaatttggtaagactttgaatataagtcctagggcaagtataagtttgtttgccttctgaatgaaatgcttgcacattacattggtcaagctagctgagcaatgtcttaaggctcttggcaaatgacacagggtatttccgatgaggttggtttcaaaactggaccttccacataaagacatatagaaatatacagctagtgaattaaaaccgcagtggccacggcttttgtcacacaaccatttgctagtcccatttctcccctaaaatcgagttttgttggaatgcagagccccatccattcgaacctctacggtggagtagacaagttgagacgcatccctgagtgctcctacagacctgggagctgccatcaacaacttgcggtgctctgagtttccaggccccttccttatctcccacctggccctctctggggtccctcacggtgagcctggaatctgtcatctctcaggtgttccaggcccttgtgggcctcggataccttcaacagggcccccagcactctccccatcttcacctgatccccctgaagtccatggcccacctttctcctttgttctgaacccaccataacaatgcctgtgatggtgccgacacacgaggaaaaggacaatcacctcatgacccttcaccctgagaggccaaggaccatgctgccccatgctctggaaggccacgttcccctcctcacactcacccacacttccactcctgggagggctggtctgtggacctacggactgcatctcagtagtgggagaaagtgaccctcacaccctcacagctctgcgacattcaccacgtggcaaaggggccgactggaagatgcccagtgaacatgcgcactgaggcaggggccccaggagcatgggcagggaagtcggtacctgccttgtgggctgtggtgccctgccttgcctcacctcatcccccactctgcaggcctgccccctgccccaggtcaccactgtggacttcaaatgtgccctccgtgggcggtttcatatgcctccggaactgaaatactacgaatagttttccccttcaaaatgcactccatcttcatcaggccctccttctctctatggacctccttcctcctgtccaggccctgcacgacagcaaggccgtagctcctttgtcgcctgttagtagaaggacagggacctcaaggcccttccccctaggaggccatggaccgtgcccgcaggctccttctcacactctctcacacttcaactctgggagtactgatctgtggacctactggctgactcttagcaacacagaaggaagtcacgatgtctccttgcatagctctacagggacaggaggcaaatagacaaggcacctgggcaacaaaggacgtgcacacaatcaggcacgtgcagtgacagccagggttttcccactgtccccaggcccacatccccagggtggtgtttgtagtagaaagagacgcgagattttttttttttttttttgtctcttgcccaaacattctcatgcatccagaaacattgggaacagagagtcccatgtcacccttagtggaggatgtgtctcagaaagacctttgtgacagaaataaagacttgtatgtctacatttacacatacttttttctcagggtgttgctctgccctccaggcaggagggcagtggcatgaccatgcttcactgcagcctccatctcctgggctccagccatcctcctcaagctgctgcctcccaagtagctgggactgcaggtagacgccaccaggcccagctaatgtattaaattgttattgttttagatgcggggtgtcactgtttgctcaggtggctttcaaacacatgggctcaagtgatcctcccatcttggccaacttttatacatgctttgattagtcactttctcctctggttctgggttttctaccatgcatacaatgtaattaactacttctgtagactcaatcaattcacatctgtacccattctttaggttgtgttaacgcatatttatacttctccactggtaactgatttcccttaatacctgtaaggtaatcacctgtaaggtaactctgtgtgatttcaacattggctcacagtgacttggaaagcctgcgtgggaagtatttcttgaaggaaagtggagagtttccaggaaccattttgaaaaacagagacaagcgatgtcctccttccctcccttgcctctcctcctgagccaggttttctattttctccattgttacaaaatcagcatgtagtattctgtgatgaaaagttttcatctctttaatcatccagtttttttcctctagaccttttttttttcctggaagggttgtatgcagatggaacaaaacattttcagaaaaacacattatgatataaatttagtgaaaagactcatcatatttaagaaatggtcaggatgaaatcctgaatttataaaaattgtaaaaatcagtttacattacctccatcccttttgtctacatcacttatccagtgagaagtgtagaaaagatgaattccttgcttgtgacagctgcattaattagtcaaacttctggaacccttccatcaatatcatacattcagatgtagtggccacaaaatgcaaagccattttacaactgtacctgtttttctttttttttcttttaatctcattgtaatttccatcaaacccctatcactaaattcaccattcacagagttacaagtatcatggccaagagagatcctgcctcaaatttttttttgtgggtggtggggtgctgcagcagtggcagcccagctgatgacaaggctggaatgtgtcttcacacacccgcatcgcccttttgaaacagggcttctctctgttgcccaaggtggagtacactggaggacttacagctcaccacaacctaggactcctgggctcaagcgatcctgctgccttaccttcctgagtagatgggactacagacacgtgccatgatgcccagctaattttgaaaattgtgaagagcaggggtctcattatgttgcccaggctggccttgaactcctggcctcaagtgattctcctccctcagcttcccaaaatactgagatttcagatgtgagccacctcatgtcgccttttttttttcctcactcttctccctttatataaggcttaaggtttatctaaatccttgctccagtccaggagactggttttttccctcctgcttgcaggaaagagcaattcatacgtcagggtttttggcctactgaaagttctttggcaacaattgcgtcctttctctacatgcctacaggagaaaacaaaaattaaagtcagcaccaggctgcacttttccttcatacattatcctgtgcagaacagcgtttaagagatccagtgagccagttctcttgcagctggagggattattgttaaatgctgtgagtacatgtatttttcataatagacaacagctcagctggtgcttcatactatggggaaatccatagtctcaaaggagtgacaacttcatcttctgtatcccttcacacttcctttattcaaacaaggttttcaccatattgtagtgagccagggtattgctggtgaatcacactgttgctgccactgtgtcagggatcctcaaggccaccctcaccttcagtgattccctggcattctctgctgcccttctgcatacaatactcctgactggagccagccccctcacctcaggtgaggataccatgtctcccactttctcaggggctttgctcctgcaatgatcactcttttctcctgaaccatcgactgctccctctacgttggatcattccccaagctaagggaaaactcaccttcttcccccatgtccttttgtaagtaccaacacatgtatctgctgcccagcaaaggaaaactgcatgaacttaagcatcacacttcactggagtccgttctcatattatctacaaaggaaaatgaaccacaatatccaaaacaattctgaagtataactttggggtattcaccgtacatgatgtcaaaattcacattaattctattttattgattgattgactatgttctcaatgaatgggaagaagtggagttctctcttagcttggggattgatctaatatagagggagccgttgatggttcaggagagaggagtgatcactgcaggagtaaagcccctgagaagaggggaggcatggcatcccgagctgaggtgagggtgctcccttgagttaggagaattgtatgtagttgttgattatgatttttaatcatccagccccatatggcaattgtgttacttctccaatattcaagacagtgtggcatttggggaaaatcaacagatcagaatagagtccagcaatagactcacagacataataagttgattttcagagaaggggaaaaggcaaaggagaaagttttttttaaataaatgatgttggttttctcccacctcgtggtcactacattgttttttattcctctggttcccttctctatgtttctcctttgcacttcaactggtcttctgtttgtctttctgccccaacatagtgcgatatttcccacagcacgtatcaagtgtctttgtgatatttgatatgttcatcacatcaatgataaaccagatcaagaaaatgtggtacatatacaccatggaatactatgcagccataaaactaaagagatcatgtccttggcagggacgtggacagtggtggaggccattatccttagcaaactaatgcaggaccagaaaaccaaataccggatcttctcacttataagtgggagttaaatgatgaaaacacatggacacacgggagaagcatcacacactggggcgtactggagggcgggggtgggaggagggagaggatcaggaagaatagctcgtggatgctaggcttaatacctgagtgatgtgatgatctgcgcagtaaatcatggtggcactcatttacctatgtaacaaatctgcacatcctgcacacgtaaccctgaacttaatataaattttggaaataaaaaagtcagtatctcagaatccctctttccatgtgtttgtcattatgtcatttatcaaagcagtatggtgacataaaagctcaggtgtaataacagttagtatgattagtgatttagcaggattatagcccagtaattactaatattgaattgcattggactgcttacagtacttaaggaaagttggtaaggaaaaatattcatgcttcaaaataattttaaaattcatgtaaaattgatcaacactgaataccacagatgtcgctgtcactggatgctaatgaagtacataatggacccataagacacagtcaataataaagggggaaataaaagggaacatatcaaagcaccatcagactagtgcagaggcacacacatgaacacaccctgcagctgcggaaagacatggtaggaagtaaagccccacaactcatcagccatccttctcaccagctcatgagttcacaaatgagtttgctgagggtcaaatgtctacagtaaaactgaccgatttaaatatcactgaatgccatttcaagccttaggtagaaagctacagacaagagtgaacttattctgagcaagtcttaatccatcatcttcacagatggctaacagaaatggcctgtaaatatcttgtctgacaaccgctaaagtactgacatccaaactcttttattacaatgcatgagagtgttgcgggaaaatcagagatgggagagacggaacagagttcaggagagccctttattattaaggtgatcaccggctcagtcggactagggtccagaaagtctgagccccgaacaaagggatcaatcaccttttaagtagtttgtggcgggagttacgtgctgcaggaagcgtacttgtggaagcgagaacaaaggcagttaatctttctttcacatttgttgcaccacatgtcttacatccttgggaatacatgtttttgtagcatttgcttatcaaccttgtgacttcacagccgcgctagggagggaagaaagaactcgctgtgcctcaaggaatgtgaaatgatggaacacagataagcctctctgagcatagaggagaaataagcagttaatattctcttttaacccaggcctctgggttggggggctatatgacattctaccttcaaggaaaataatacatttcttgactattatatttaaaaaattcattaattcccccttcatttccccactttggtgcttgccatacatgcagattaataaagggcaccacagtcgtttatgtcttccggtgtaggctcatattcttcttgagggactgattggtatttttgcagtgccattagtttggtggtagtcgtccggtctactactgcttcagtggtggattggatgcttctgatgagaagaagtaaaagccaaggcagtattaggcatcctccagttatgactataaaaccaattattagagttttaaagcctccaagccatgagaaccatcctccaaaaagtgtatttgggctccatctggaccaggtctgcactgagacatgggctaactttcacatcttagcagtaatttccataacagctcttccattgttgtcaatttgtaagcaacagttggtcaaatttagtttgccacaaactcctcctttggaggctaggagatagtctaacgctagcctattttggtatatggcatccctcatttgggtggcatgtatagctagcaaatctaaggctcgagctgtctcattgactataatttctagtaccgcttgtaatcttataattcagttcagcatgtatataggagtatggtaaccccatgacccatcttgggcctacgtagttggtccataatattttatgatcctctctggaggctattcattgtctttccaatttcttatttcaatgtcttttcttatgtttgtgtttacctttttggcggtacttatctgggtagagacatttcttctggtccttttcctttctttgttatagactgggtaacttaaatcttctccttgggttaatgggagtaagaagaaagatggtcttattgttcctaatacacaggctctgatccaattttcaggcaatagttggtaggcctttgtcccagagatccagtatagtcctgctggtgccttccaaatatttgggacatccagccgataccatgactgatttaacactggaaattgggagaggggattgaaatccagcacagaggaattatctgtacaacttctctcctgggtcttattttctgattcctcgaaatattgttgatgtgaacaagttgtatcccctacctgagtttgaaagtttttttccccatcgtgctatgcaatatctcccaatgataggggcctttagtagccaaacacttgggttggcattgaattttgtaacaaattctggtatggtaaaattatcttgtggcattaattctctggcttcccaaggccattgatctcccatatttgtacctccacaaacataacgtgatgtgaccccaagattagtagcaatactttcagctagttgagcaaacagattttctgctgttattggtggaatttgaatctttgattctttggggtcgaaatgcttaataaggaatttataaaacctgaattgctgcattgggttaacttgaactttagctcgttgagtctttttaataattacattcggaatcccttggtttgctccttcctggttaaagcccattagtcctttatgtccgttagtccagaaaggcatatttggtttcagtatagtcagattgagggggttgcatgttcgggttgtgcacccaattttggctttcaggcaggcaaacaaagccactcttcctgggtaaaggtgctgactgaactcgtgggtagtccattgactgtgacagtcaagacaatccttttctgtttctcccattaagatcttagcagctttgctgctgattctttcctggcctagatccctacagaccactcctagattgttcaacttgctaagatgtgcagcttggcaggcatcaaaatatattgagacaggccctctgtgtgaaaaaggaaatacctttgttttggttacaagcttccctactccagtgtctattggattcgtatatgatggcaacaagggttcccctattcggatttcaagccagaaatcgtagggcagggattccagatcataacagatttgaggctgcccatttcccaggtcacaaacagagtagctggtttggttataaacacaagttcctacctgagtccctgtgcactcatagtaggtctggtatatcagagtcttagttatgcctttttcagaccaagcatccatcatgcagtgatggcaactatcttggtttccttggacagctgttagcatttttgctactagtacaatcaggtttagactatgcacgggcatcctcctgggcagcaagttcgacagcaattgcaaaggtaacatgacagtaagacaattagtacaagcaaaagaataactacactggcaaattctatccacatttacttatctggcactggcttcctcaggcttcggccatgtgtagactactcagcttccggttgtgtgactagagcaaggtttggtgtttcttcaagcttcagccatacatggaccgaccagcctccagtgtggtcggagcagggcagtcgtccttctctgacgcaccttggtctttctgcaagatcagtccagctggattatctggatcttgcttacttgtccaccagtctggagctggggctgcaggtttcagcaggctatgatgaacccaaggtgtgatacctgcaactttaacagtggtaggggtagacatgattgttgtgggaagtcaggaaccccgaatggagggactggctgaagccatggcagaagaacatggattgtgaagatttcatggacatttattagttccccaaattaatacttttataatttcttacgcctgtctttactgcaatctctgaacataaattgctaagatttcatggacacttatcacttccccaatcaatacccttgtgatttcctatgcctatctttactttagtctcttaatcccatcatcttcgtaaactgaggaggatgtatgtcacctcaggaccctgtgatgattgctttaactgcacaaattgtttgtagagcatgtgtgtttaaacaatataaaatctgggcaccttgaaaaaagaacaggataacagcaatgttcagggaacaagagagataaccttaaactctgactgccggtgagccgggcagaacagagccatatttctcttctttcaaaagcaaatgggagaaatatcactgaattctttttctcagcaaggaacatccctgagaaagagaacgcatccctgagggtaggcctctaaaatggccgcttcagggggcggccatcttttatggtcgaagctgtagggatgaaataagccccagtctcctgtagcgctcccaggcttattaggacgaggaaattcccacctaataaattttggtcagaccggttgtctgctctcaaaccctggctcctgataagatgttatcaatgacaacgcgtgcccaaaacttcattagcaattttaatttcgccctggtcctgtggtcctgtgacctcgccttgtacactccctccccttttgaaaatcactaataaaaacttgctggttttacggctcagggggcatcatggaaccggctgacatgtgatgtgtcccccggacacccagctttaaaatttctctcttttgtactctgtccctttatttctctcttttgtactctgtccctttatttctcagaccggctgacacttagggaaaatagaaaagaaactacgtgaaatattgggggtgaatttcgcctgatatctggctgaatttcccccgatacatgatcacaacatgggggccatcccataaaggcctgagggtgatggggttccaacgtttaacccatacagagtctctgggttgaaagggttgtactgcatctgtaagactaacaggtattctctgtcttacccacccttgtacttcttgcattacttcacctaatgcctgcatttgtctccttagagttagttctcctatttcttttaaatctcctcttatttgagctatgagttggggtggtcggccatacactatctcatagggtgaatacccagttaatttagtgggggtacacctgactcagagaaggaccattggcaacacctgatcccaccttaaatgagtttcctggcaaaacttcttccacagttgtttcagtgtttggttcatcctttcaacttttctggaactctgtggatgataggcagtacgcagcttccgtttaacatttgggttaactgctgcactacttctgccacaaaggctggtctgttatctgagcctaaagttagtggcagtctaaatctaggaataatgtcttttagtagtatcctggttacttctcgagccttctctgttctggtgggaaatgcttcaacccaccttcaaaaggtgcagactaacactaacatgtactgatagtctccagcccaaggcagctgggtaaattctacaagcaggttttcacatggcaactgctcctgtttcttgaattcctgggggccgagtgggcccttgtctggggttattttgagcacatatgacacattgctcgcagatggctcctgtgacggcagtcaggtgtggtacaaagaagtatcaccctacaagagtttctaaggctgtcttccttatctgtgttccttggtgaagttgctttataagtcgaggggcgacggcttctgggatggcaagcctcccgtctgaaaacttccaccagcctcctttctttgataatccccgttttcctgtgcgaaccatgccttttcactggaggtgtagttaggagtttctgcaaggggaggttctaataagggcatgacataagtctctcttttttctgtcatttttgttattgcagccctttttgcttccctgtctactttcctgtttcctgtagcctcattacttcctcctgtttgatgtccattacaatgaattaatgctactttctttggagtccatactgcctctaggagctgctctatttcttttttgttctttatttctttcccttcagtagttaacagtcctttctccttgtagatggctccatgagcatgcaaggtagcaaaggcatattttgagtcagtatagatattcactgactttccttttgctagaagtagcgctcttatgagagctattagttctgccttctgtgcagaggttcctactggtaaagggcaggcctcagcgactgagttcagtgtggctactgcatatccagcctttctgataccttcggatatgaagctacttccatcagtaaaatactctatgtctgggtcctttaggggctggtcttttaggtctttccggcttgaaaagacttcatctactgtttctacacagcaatgataccctggggcacataacgggggcttcccatgctctgcatattctattggcagaagtgtagccagatttagggtgtttacagtctctaaggtgatgtatggattttcacacaggagccattggtatctcagcattctagggttagagagccaacgatgtcctcctctctgttccatcagggtgacaactgtatggggcacctgaattatcaacttctgtccaaaagtgagcttgttagcatcctcagctaacagagcagtgacagccagcaccttgaaacggggcggccatcctgtggccacccagtccagttgcttggacagatatgctacaggtagataccatgaccctaacatttgcaccaagactcctgtggccatctcctttctttcatgaacatacagataaaagggctttgtcaagtctggcaacccgagtgccagagcttgaattaaagctttcttgatttccttgaaggccatgtcctgttcttttccccaaaggaggggctcctttatccccactttggtagcctcatataaaggttttgctaagagcaagtagttggggatccatatacggcagaaaccagccaccccaaggaactcccgtacatgccagtgtcgtgtctggccaaggaatgctacacacagtctcttttcgctctcgcacaagctcacgccgcccttggggaataggaaaaccaaggtactgaactccttggccacagatatgtgcctttttcttagacactttatagccagcctcccacaacactcaaaggagattctctgtcccttcgatacattcctttctagtgggtgcggccaacaataaatagtcaatatattgcagtaagatacaccggtcactaggtggcgtgaaagccttcaagtctgagacaagcccttcctcaaagataggggagttcttaaatccttggggaagtctagtccaggtatactgaggtggtccccactcaaaagcaaagatgtctcagctcataggggctaactgaatgcaaaagaatgcatcttttatgtccaggcatgtgaaccaagcagcactagcaggcatttgtccaagcatagtatacgggttaagtacaacagcatgctgtgtagccgccaccttgttgactgcctttcagtcttgtacaggttggtagtcaccagacggttttaacactggcagcaagggggtattccaggaggaggtacattcttctattatccagaactcaaggagtctttttaaatgtttttcaattccccaataggcctccatgggaatgagatattggcgaatccgcactggataggttctgcgcagtaactctactaccgcaggtgctctattcactgctagcccggtggggttgtcctctgcccagacacctggcaatttaaggagcagatctgtaaacagtttttctcctttagctacagtgtatctctttccacattcttgacaattgctttcgtaaagcctccattcctctgttttttgaatagtgagtgttaataccatagcctctttcagtcctaggcttaaggtcatatctccactgggtgtaaaggagatctgagcctgcaacttgtgtagcaagtctcttcctaatagtggcactgggcaatttggcaaaataaaaacttgtgttggacttcttggttcccaatcatacacctcctagatttgaaaaaaggtgtcttttctgtggtacctgtggctccgataatgttcacatagtcctttgataacggtccaattgtctgagtcacaaccgagtgttcagcacctgtatctatcatcaagtctgttttttggccccctactaccattgagaccataggctcctcggggcccagtgaaatggagcttggtctgtctcagtcctcaagataatcgttggctcctgccagcccagttagatccatgtctgctcctattatgtcctgttcagtggcagaaggaggtcctatccagccattccgtccctggttgttgcctttatcttttcccttctctgggcactcatttttccaatgccctctttgcttgcacctggcacattgatatctctctagtcttggctgtccttcctgacctgtcctggccttctggcctgacctagcttgttctctaccttgaccacatccttgaccatgtccatgccctcttgcaaatctggcttctctttcaaccaaagctgcggctaaaaactctgccttctcctttgccctacacttggcttccctcttagcttcttcatcccaattcacataaatcttggttgccacctggattaactgggatatgttcataccctcaaacctttctaatttctgcagctttcgttttatgtcattctgtgcctgacttacgaatgctgcattaaccatgcactgattccctgctgcttccggatcaaatggcgtgtagagccggtaagccttacaaagcctttcacagagctcactggggctttcatctggtttttaatggacctctgagacttttccaatgtttgttgcttttttccctccagcttttattccttgtactaacacttctcgatatctcaacaagttctgcagtccttgagcctgatttgggtcccagccaggctctatttcagttggtaaagcctgctgcgcatactgcttaacattggctgtgcccacaggggcattgctctctagccactgatgagccgtttgtattacttggcagcattcgtctgtattaaacagtgacaggaaaagttgtttgcagtctgcccaagttgggttgtgggttagaaggatggacttcattaggtcaatgagagcctggggcttctccgtataggagggagtatgttgcttccaattgaaaatgtcagtagtggacaagggctgatagacataaatctgctcccctccctgaacttcattttgtgcgtctaaatagatttgccctctggtctcttggaggggcatttgcgtggctcgggcacgtccggaccagagccagcctgccccgtcctgaaactcctcctttgatttatctggcagtggttccagtccttcccactatggggaagtttggggagtactctcttatgaatccaaccctccagaggtggctaccggagcagcctcttgcctaagcctctccagagatgggtagattggaatgtagtggggtggagtttccaactctttgggcggggcttgtaggacaggtttttctcattttccttgctgctccttctcctgagacagcgctttgtgggttctacagtgccctgatttgcatgagccactaaagtcttacaatcatcttcaaagcaggcctgtagccattttgggtggttctgaattacgctcagccaggagtctatatgtggaaactgatcagggtgcccaggttgttccccgactctggttaccacccagaacactcggccaattgtttccctatctatggttccctcggcagttccaccctacattaaaagagggccagtcaatttcaaaaagtgttctcagcctctgtggtgttaacttcattccataatcaccatcaaagcctttcctaaagttcttcaacatacattctgatggagctggcttccatgcatttcctcccatttcttccctttcggtgcactttcactctcactttcactctcagagtcaccagaccaggtcctattatgggaggttcagatgctgcttggccaagtcacagccaactactgctgtgaaggtataaacctgatcctgtcggccttatgcagcgacctaggtctggctcgtcccacactcacttccgaggacacagtctgcgctgagagacttatgcctcccaacatcactccccgcattggcctctcacaagactgtctctttcatgctttttcacacacctccccctttctcccaagaaccagtgtcctgagactggctcatgaactttgttcatgcccaatgccaatctgggcgtgagttttgtctgagtcaacaggcccctcccgttgattgctctctagagtaggactaatcgccgcaccctgagaggtgatcaggctccccttctgtccttatgggacgggctttcctagggcccaaatatagcatggttcagtagtctgcctgcatgctgctcctgtgactgtcctgcaactcccgagtcggttccgtttgcgctgtcaagtgaaggcttcaagacacgagagagccgttctccttctgggtaacttcacccagtggcgccaagggtcccaaatctcccgcgtcctggggctcaagcccataggtaaaggagacaaaaacctaccatctccaatcccggatgagcccccagaaatgttgcaggacaaatgagagatgggagagacagaacagagttcaggagagccctttattgttaaggtgatcacaggctcagtcggactagggtccagaaagtctgagccctgaacaaagggatcaatcaccttttaagtagtttgtggcgggagttacgtgctgcaggaagcgtacttgtggaagcaagaacaaaggcagttaatcttttttttacatttgttgcaccacatgtcttacatccttgggaatacatgtttttgtagcatttgcttatcaaccttgtgacttcacagccgcgctagggagggaagaaagaactcgctgtgcctcaaggaatgtgaaatgatggaacacagataagcctctctgagcatagaggagaaataagcagttaatattctctttcaacccaggcctctgggttgaggggctatattaaattctacctttaaggaaaagaataaatttcttgactattacactcataaaattcattaattcccccttcaagagtacacagtttgtatatagttgactacgcaaataaatatatgtatgtgtatggggatgtgcactgtatttgtatattctatatgcagtgaatgctctttagtaatttattttatctcctttttttaaaatgctgttgctggctgacaacattaaccttatgatccaccatggattaaaaaccagtttagaaacgactaaaaccttttcagagaacatccttatgttgctatagaatatatgcaaatacacgtgagaacccatttttgtccacctccttagcaattcagtgtttttagacaaaaagttcttctttgatatgggccacaaagacaacaacaaaaggtacagttactgatgaaatgtttgtcagttatcagcgtctgttttgcacaggtgaagtcttacttgcacagacaggaactcacaggcaaaagggacaaaaaatacacgtgacttcttgtcctcttggtatcacatgcaggctttgcctgggctgcagcatagctgaatgtcatctatggcatccattcacagggggacctccatttccctactgtgctcccatgttatgggacaagcaggagagttgcactgaacatggtaggtagtaaataatttggcctcaaccacaaagcaatctgagctcacatgtcagtgtttaccctgtgccctgaaacttgccagctgctcagaatctgtagactttgtcccacccaccaaacatcctgtggaaatctaagtttggtcatagattcccgtgcatggaagatgggaagctctgctcatgtgggaaattgagccctcccacaggtagactggctgtgttggtcccagctctgtttcctcccttagcagctagagagttgctagggtcatgtatcaggcaactcttctctctacagtgtcttttatactttctgttgcagcctgtgagtcacaagggctccttcacagcttccctgatcccaatcctattatgatcctttgaactcatccagcaagtctggagttatattccataggaatggcagcaggaagctcaaatttgacatgaaattcaagcctgccctttgagctggagtgaggccactcaggaatcattaaagtccaggtctgtgtgtgatggttaatattaagtgtcgagttcattggattgaagaatgcaaagtattgttcctggttgtgtctgagagggtgttgtcaaaggagattcacatttgagttggtgcgctgggagaggcagatccaccctcaatcatggagggtaccatctaatcagcttccagtgtgggtagaataaatcaggcagaagaaggtggaaaagctagacttgctgagtattccggccttccactttctcccatgctggatgcttcctgccctctaacattaggcttcaagttcatcagcatctggactcgtggacttccaccagtcatctgccaggggctttggagccttcagccatagactgaaggctgcactgttggcttccctacttttgaggttttggaactcggactggcttccttgcacctcaacttgcagatgacctcttgtgggacttcaccttgtcatcgtgtgagtcaatactccttaataaactccacttcatatttacatctatgctattagttctatccttctagatatcgctgatacaatacagcgatatatatatatagtatatatacatatacaatatatatagtatatatacatatacaatatatatagtatatatacacaatatatagtatatatactatatataatatattaatatattatatatattaatatattatatattaatataatacattaatatatattatatatatcgatatatattatatatatctatatatattatatatatagatatatattatatatatctatatatataatatatatctatatatattatatatatctatatatattatatatatctatatatattatatatatctatatatattatatatatcgatatatattatatatatctatatatattatatatatatgtattgtatgtgtgtatatatatatatatatatatatatagagagagagagagagagagagagggagagagagagagacggagacttgctctgtcacccaggctggattacagtggcaagatcccggctcactgcaatctccgcatcccgggttcaagtacttctcctgcctcagactccctagcagctgggattacaggcactcatcagctcaccaggtaatttttgtatttgtagtagaaacggggttttggcatgttggccaggctggtctcgaactcctgacctcaggtaatctgccccccttgacctcccaaagtgctgggattacaggcatgagccaccacgcctggcctccctcactttaaaagacccactttacgccaatttcaaaatcagaataaatatacctaaatccctttgacctctaacatactagtgcccctgtcaaggtagtgctctcccttacggcattatgcaaataatgtcagccctgccttatgaacaggctacttggctgatacttgaggagtacagtatatgatgcagatagtcaccactgctgtgcatcatgtcacagtagactgcgcctagatcctgtcatcaatatctatgaatatttctgaaccataatacacagtgtgaatgacctacaggtatattcaggtaaatcagttaccattccacagatttaaacgtgcaataacacaatcttaaaaaaagtaaacacgtgtgaatatatttagtctgcagaagagtttattccattacattcattagaagcatggcagaaaactgaaaaccagaggaaaaagtgattaatcaaagcatgtataaaaattggccaaggtgtgaggaccacttgagcccaggaatttgagaccagcatgggcaacagagtgaggcccccctctaaatataaattaattgcccaggtgtggtgttctcatctctagtaccacccacttgggaggctgcaccatgaggattgtttaaacccaggagatcgagagtttagtgaggtataggacacatcctccattaaaggtgacatgagactgtgtgttcacaatgtttctcaatgcatgagattgtttgggcaaacaaaaacaaaagctctctttagtctctctttccttctttccttctttctttctttctttctttctttctttctttctttctttctttctttctttcatggagtttcactcttgttgcccaggctggaaagcaatggcgtgatattgtctcactgcaacctgcacctctgggttcaagcgattctcctgcctcaacctcctgagtagctgggattacagacatgtgccaccacccccggctaattttgtatttttagtagagatggagtttctccatggtggtcatgctgatcttgaactcccgacctcaggtgatctgcctacccacctcggcctcccaacgtgctgggatttcaggcatgagccactgcacccagcctagtccccttctttctactataagcaccccgtggatgcgggtatgagaacagcaggaaaaccatggcccaccctgcaagtcctgcaagtgcctgactcaatgggcatgccccttgctatgtaagttcccgctgcccatgcaccttgctgtctgccttctgtccctgcagagctgtggaaggaaacgtcgtgactctttcttgccaactgtgacatagcaggtaggtctgcagatcagtcctcccagaagttgaagtgtcagtgagtgtgagggaaagcagagggcttcccatgggttggaccacttgttccatggcctcatagaggtcgtcatccttcaactaaaaggcagcaacaccgccatggccttgctgttgtggggtcccgggcaagggaggaaggagggccgtagaggggaggaaggccaagtaaacatggaattagttgaagcatgacattatctgaggtatttcagtctcgaaggcataaaaaaccacagagaagatggattccaaagtccttagtggggaccttggaaggggcagaggacagggcaggaccggaggaggaagggcagtgcagcccttaaggcaagagaggacctcactgtgcatgctcctcgggtgcccacctcagtgcacatgttcactgggcatctttccatctgcccctttgcccatatggtgaacgctacggggttgtcagcctgcagctcgggaccctgaggtctggattctttctccactactgagacgcagccggtaggtccacaggccaattcaactgggagttgaagtgtgaatgagggtgaggaggagccagtgggctttcggaggctcgggcatcgtggtcggtgactccaaaggagaagggctttgaggtcaccatccttttcatgccgcctggcgactatgggccttcttgtcttgttggagtctgaacaaagggagaaggagggcctcagagtgggttggggggtggtgtaggtgaagccagggtgatactggggtgctgttggtggtatccgagttccagaaacgcctgaaaaccccaacagaggacagattccagactcctcaagggggatcagggctgggacggcttgggcggtaaggaaggggcctggaaagtgggaactcttcggggtggtgaccttggctacaaggtgtgtatagtgccctgcagaggtgcccaaccagtgaggaccacccagcgctgtgtggcaacttctcaactccatcttggaagttccaatgggtggggctctgcgttccaacaaaacttgattttcagggggaaatgggcctagcaactgggtgtgtgacaaaagccatggtcagtttaattttaattctcaaggtgtattttcctaaatgcgtcatgatggagagtccagctgtgaaactaaacctcatcggaaataccatgtgtcttgccatgagcattaagacattgctcagctagcttgatcaaattaagtggctgtgcaagcattcgattcagaaggcatgcacattgatacatgccctgtgtcatacttttcaatatattaccaactttttaaaaaataacaagttaacatttagccatggaaatgctcaaatatagtatcctcttacatgcattttcccacagtattctgtttgcagagtgaaatatgagttggcgaggaagattaacatgtagatcaagacaatatttacagcctgttcagccgattgggcctctgcttgtgaatgtcttaccattcgatgttttctatttgcagaaagttatttttctgatagtgttgttggactcgtatagatacactgataaaggcctcccatgttgataaaaaatgattgtggcatctcatgaaggaaagactaacccaagaagactaagtactggttttgcgtggattttgctgatgattccttcctcatgcttatccatagcacattacatacattcaatccaaggtaaattaaaatggcttccaaagccattgaggataactgccttagagtaacctctctatgggaagagtaactttatgaagaataagtatgtggaatagtgtggggatagtgttggagcatgtctttcgacatgcttatgatcagaagtacctatgtaatctgtatattcatattattgacatgtattgataaaactttgcacacacacagacacacacacacacacacctcgtcccaggagcccagtgtgccagagccttaacaagaggaaccacaagctgaaagtcagaatggtacacctggtcagaagacagaagaagatcagggtgcagctgagattcgaggtggtgggaagggaaagaaagaatgtctatggggggaaggaggcctgtatgtgcatcatgccctatgccatgaccagtaacaggaggaaagaaaacattaggaaaggatctaaaacatttgctgagagttggctggaaacgtgacaggcatagtttgcagcttcttgcagtccctggatatgatgattcttctctttttcttcgagatgcattttgtaggcttgaaaatacagttcttcctaaatcagatgaaactgtttaattggttgtataaaaatgtacattatttcactcatttaatttgatcttcttaggatgttgcagtgtgacctcctcagccatgctgtccacagtgttgtaagcaccctttaataacatgtggagtgtcaagtcaccctaccttttaacatcctgaataaagaccatttgcaaagggatgttagccccattttatcaataagaaacctgagacttggagatagaggttttccaagaccacttgactcatggagaaggaattcatattttgttccaaggtttgcattctttctaccatctatgttgttagaaaatatgaatgattttgcttacgaatgtttaatactcggatgtctctgtactataagatacttcaatattggctcaggacaaaacacagttcagtgaagcaggatagcaaccccagaaaagagctcagtgaatgaaagccactgttgcgttttcctctgtatttttgacagtatgtttggtaaaagctggctaattcaggacactagcatacaggtagctatattagtaggattttgaaagggcttttaaaagttgtttaaatacttttgtaattagaaaccccaaagtacgataagattatcatgaaacagaaataatttcctcaatggataacattttaaaactaaacatagaccgaatttgggccatgtattattttagcaattcactgttgagggatttccagaatatgagtcaacaatgcccattaatttctttgcacttcagttccagtactctcactggaagacagtgattttgctattatattctgtactgtttcttaatggcaatcatgtatggaaagtcacatagagggcctttggacctaagcatcgctttaattaagtttaactccaacattttcaaggtacctcaacacgggaggagtgtcaggagtgtaagatttgtcatagggccaccaatacattgatctaattcttcagaaaattacatttaaggtatgatttaattgctttccatggggcagtcttcagaattcccagatagcagatactcactgtttataatacacaaggttaaagtataggaaacagaggtgtggtgtgatttatcctcagattgtcatttaagataaggtatcataatacaggaaaacaaaggcgtggcatctttgcatcacatttataaccacagttgcctacaggcttttattgcgtaacactgaggaaaagaatattatcatttccttagttatctcctttgcctgctttaattaataacctttgtgtttttcagcgcctgacctggcagctgatttccaggagctgtctcagtcaaagactggggtaaaggcagagatggtcctgatgtccaggggaagattctgccaaaatcagagcaatttaaaatctcataaggaggtatgttatccattaagattcagaattatatgctttctgttttccataaaattatatttttgataataaaaagagagaacatcactgcctctttaaacagagttcaaatgcagacctttcttggaaggtagttcagacccaacatgcctgactgcaagactgaaacactatcagatacagaaacaaacaggctcaaagccatattgaatcatcaaataggaaagcattttcttacttctgagtatatccaacagctaacaattttcatattattttctaatttctgcttttcatgaatgcataatacatttgtaatgccatcttatatgaaatatgctgatccctgaaggagatcctagtaccagctctaacataatttgtgagattctggacaaatcacataaatcctacacccatttttgcttttattgaaagtagtgaatgcacatcagatagactaaaatccatttcaatgctgatttctgcatgctctggttctgttggagagaaaacaaagatactctgattttcatgatttgtttttcgtaacaatcatcttcagttcaattgtaatatctgagttgagatttcattgctcctaagaaaatgagtggggactctgcttgatctttgtttttgtgaatggagactttcatgagtgttcttggattttgtcagattctgaattctcaggctcttaaacaatgattgcattttaaatctttcccgcagtgaaggctcgaatgactgaataataacatggcaagagacagtcaggtttctgtggccgataagtagggagcatgcatgtaggtcagtgatgctcaaggtgggtgtaagatgcctgtgctaagcatgatccctgccctccagtcccttcatgagctactgtgtgtaattagattgaagacacatatgataggatcacctctaaccatggtttctgccttcagtcatcagatgatacgatgtaaagttcaaagactgtaatgtaccaattcctgtgtagtagacataaatctcttttacacacattttcaaaattgctgacttaattagaagaacttctgaatttaaaggaagcattgcatgttcaagggagaaattacctaaatgtttttactctacactgcagaacccttccattcgactatttatattaaaagatagtttttcagatgattttcaggagcctattgaaaaggcatcagttgaattcttcagagagtcatagccttaaatgcacatcttattaaaatagatagcaaattacacgatacaagaaaataataccaagaaataaaaaaattataaaagagtcacagaatgaacttaaggaagaaggaagcaggcagtaaataaaaggtacaaatcattaacaaaaggaaaactaatctaaaattaataaatttaatagattgttcttttgagaaatagctgtgaagagagcatctagtagtttacacaatcttgaagaaaatggataaagcacagcacggaatatgagcaagacacagatattgagtgtagggcataattgaaagtgaatacactcttgaatactaatattttcagagtatggatgaaatatttggcatgctaggaatgcctacattattcaatctatccttttaatacctgaatatctgaacatcacaaagactctgtatgagcttgtgaaatttggcagttgtccctcacaacaattacttttagaagcaaatatttagctttcccagttgtctttctctcctttttcatttccctctccatttcttttttttgccacactgtttacgatgcgtacctctttcatagtgtaatatcaataatgacagtgacagcttaaaacttgtatgaccatttaattaattatacaaagaggaatactttctggtgaaaaaactatcattattcatattaacatgaggtctgcaggtgaaaactagatgcaaatggttactgtatgttaaaacacacacacacacacacacatacacagagagagagagagagagagagagagaagagtaaactagcccaaagcaatatttttacacttctgcataatagagaaaaaacaaatgcaatactggcctttctattcatttcacttatgtatttcctaatgtaacattaactattttctcaaaacatagttttctgactatttgcaggagcccattggatatccagaccatagtttcaagccaaaacattaaattatacatttttcacaaattccttctgtttcttaggttttttgtgttctggttttattttgagtaaaaccctacacaatgtttactatctaatttaacctcttttaataggttcactggatttaatgtattctgacctcggactgtcttttggtttccttctagcaccaaaagcaggttgtgtttaaaacatgttgctaatgtatatgcttggaagtctatcttcaaagtctctacagagatctagttgaatgctagccatagggtgacttttaggcttctggttttagtccactgtataaaactaaaactttggtgtcctttgtatacctttcatttcatctgaatacagttctgctagtaatgttccctcctgttatatttttgttgcaggtaaagggcaaccacaggtttaaacgaaaacaagctgaaagaatgcaagctgaatttttctgagatatttggctttaaaaaaatctcaataaagcttcacagctttctccaaagaagtcttgcacatcttttgttcatttattctcacatattagacgctaatgaaaattgtggctgggtgcagtggctcacacctgtaatcccagccctttgggaagctgaggcagcaggattgcttgagcttgggagactgagatgtgcctgggcaacatgggaaaataccctctctgcaaaaataaatgaatgaatgcatgaatgtattcatgtatggatgtagctgtagtcccagctactctggaggctgaggtgggaggatccctggagcccagcaggtcgaggatgcaggtagtcacgttcatgccactacaactccagcctgggtgactgagactctgtttgaataaaaaatagtacaatttttcaaactttgcattctcattgatctggtatccacaggtgtggtattgtgaaatatatatttggtcccacaccccacttactgatatacaactcctacaatatttagaatctccacatagtgatgccagtgagttgcctgaaggctagcagttcctaggtagctctaggatgggggattagagcattgggactttcagccccatccccaacattcagggcagggagaggggctgaaggttaagttgattgccaatggttggccaacgggttaatcaattatgcctatataatgaaaacctccgtcaaaacccaaagtatagggttcagagagctttaggctagctgaacacatggagggtagcatgcccatagagggcatggaagctcccttccccttccttcattccttcccctatgtaggtctttatatgcaccctttgttagggtatcctatttgccacaaaatatgtgagcattccctaggccatatagctggatgaaagaattagggcctaggtagaagaaaggggaaagcaactagggcaacttcctgaagcaaaattacttcggtcctacctacactgtctcttataagttatgatagccatgggtttctatcctgcttctcacacactggccttgacatggtgggcaagacacatcctgtgggactgtttacccatttctgaagttgaaattacaatatttacactaaacagttgctatgaagaataaatgaaataacataggaagcaggtattacatagcacataaatttattagttatatttccttaatccctttaaaattttaaataatgttctttcattttgcattataattacatctctagtatgttaccgatgctttggaatttcaagtaggaatatcaatctaccttcttaaatgcatttgacttcacaagcatattttatttaaatatgtaaataaaatagcaatgtagctggtatcagacatgacattgattctgaagctgatttgtaaataactgaggtgtgacaaggccaaccctatggcagcagtttgggccaaaaaatttctttgttgtgtgtgatgccatgaagaataagtcaatattctggtcaggtaacaccacataactcaaaacaatagtgtgtcagttgctcaagcagtccctaagcagccctgtggtggctaatggggccacaaggatcaccagtgcagttgcttttggcttgtcatatattcatagatttgctgggtaaaaagacaatgaactcaaattgatccaagtggttgaacacttgcagacgcagctaatgcagatcgacactgtctcagcactgtgtccctagccccgcaataccacactgaatcagagatactcagtgatagcatagatgttgggtctctctgcctgggagtagcccacagtcataccctaaggccaaattggaaaccacactgaatcctgaacccaagatcacccctgacagaactgcgactatgggacagcaggggtgacccagctcccaaacatcccacacagaacacttagtgatgtcatccacgcttgtgaagaggagaaactggtgtcaatgagtaccctgaacttactgccttctaacagtttgcctaaatcaaagacccaaatgaattgtttggactggaagaggaaccctaaagggaaaggtccctcagtgggaggccacactggaggccttggccagctcctgcctgatgaatgtatgacctgctgggggtgccctaacaagagtagattcttggtgcccaggagtaccacctatgccctctgggattgtttttacgtgtgtgcactcactatccatcactgccttatccctggaaggcattcacatcagcttcatcttcctggccagagttgtgctgagcctgaaatggtggctcacgctggacaaaaatggttaacacagaatcttaggaaggaggtcccctgcctttctaagatagaccttcatcattaataggatttgtataagacggctattatgggaaatctgatgtgtcaactgtgttatgccataaagcacaaaaaatgttcactttgaccatggtagatgtctctgtgaaaagttttctccacataagaactaacatgtacattggcagactttgggtatacctaattgccctctataatgtcggtgggcctcatccagtcacttgaaggccttcagagaaaaagactggggtcctttcaagatgaagaatttctgcctccacactgctcttggatttgagctctcatatcagctcttccccaggtctgcagcctgacatcctgctctgcaagatttggacttgccagcccacatagttgcatgacccagtacctcaaaatcaatgtctctcctcaaaatcaatgtctctctctctgtctgtctctctacacgcatgcaaacacacacacacacactcacatgaacacagagtaactctaaccaataggctgcttacatctgggacccttaaggggcataactgagatcactactgcaggttggtctcactctgctgcatggctcctaaggcagaggcctgtggcattcccctcacatcctctgcagactgacatccaaatggcttatcactgtgagtctgggtttggttatccaaccatgtagagatcactacaattccacaggtgttccctgccctccttctgcctgtgagttcttctgttctatcctgaggacacacagatctactgggtatgtttccaaacttccaggaaggacctgggagcctggtgagggagatacacctgcgaagggaacttcagtgcagtaacagcaatgggcataaccggtgtgttcaccaaatcacgagagatcacactaccaacatcgcccacttgattttccccatcaactaacagcttatcttggaaacgatagttttggtagctaagttagactccccttattctgttttccacaggaatccacagattcaaagcaaactgatactgaaatgttgtgtcaaattggaatgcaagaatggaatgccctgtagtggtatgatttctgaagcagtcaataagtctttataagttcccagatgaagcaacatacaagcattcctcagtttacagggagtgacatgtttggaaaatccagttacaagcttaatttttttttaactatagactccattttttaaaaaatttagtataattttcgaaattttgtattctgactcagctggtatgcacagttatgatattatgaaatacatatttggtcctagaccatgcttcctggtatagaactcctacaatttttaggatctctacgaagtggtgtctttttgtatgctagtgagttgactgatggctggcagcacctaagtagctctaggctggggaataagagggttgggactttcagcctcacccccaaacatcagggaagggagaggggctgaaggttaagttgaccacctgtggcgggccaacggtttaatcaatcacgcctacaaaatgaaaacctccatgaaaacccaaaaggacaggattcagagaggctccagcctagatgaacacatggaaggaagcatacctgtagagggcatggaagctccctgcccctttccccagacctcaccctatgtgtctccttatctgcttcctttcttagggtatcccatttgccacaaaacatgtaagaagtccctaagctacagaactggatgaaagaattagggcctaggtagaagaaaggggcaagcaaccagggcaacttgctgaagcaagatgacttgggtcctacctacactctctctttacaggttatggcatgaaatagtcatgggtttccatcctgcctctcacatactggccttgagatggtgggcaatatgcttacatcctttgggactgtttcccttcttccaaagtagaaattacaatatttacactaaatacttgctatgaagaatgaaggaaataacataccaagtaggcattacattgcagataaatttggattactacttagatttcctttttccctttagatttcaaacattttcatttcatttttccttataactgcatctctagtatgtgataagtgcttttgaatttcaatttggaatgtcaagttacttttaatctgcatttgacttcagaaaattatttgatttaaataaacgtattagtgaaatagcagtgtagctggtgtcagacatgttattgattctgaagttgattggaaaataaccgaggtgtgataaagccaaccccaagtcagtactatgtaccgaaaacctgtttgctatgtgtgatgccaagaagaataagtcaatattctggccattcagcaccacacaactcaatacagtagtgtgtcaagtgctcaagccatccgtaagcagccctgtcgtggctaacagggccacaaggatcaccactgcagttattagtttaccttgtcacatattcatagatttggccaataaggagatcatgagcccaaatggatccaagtggttgattgcttgcagacacagcaaaagcaagatcagcattgctttggcaccatgttcctagtcccatagaatgacagtgaattgggggttctcagtgacagcaaagatggttggtctctccacctgtgaggagcccacagccgtaccttaaggcagtgggcacttttatactccataactgtaccctaagatgaggaaaggtctgtgcttacctgaaactagggagatggatgaagaatggccttgtttcagcctccaaccagatagggaactggtgagaaataacctgtagcagttcccccaccatgcttcctatctccccttgctccaagggcattcaatgtattctgccaagactcaggttagactggaatctagttttgcatatgtgccctatgtggtgacctgttagagctccagggcaccgtggcagatgcattaccctagagtgtccagcacaaaatcaaggatcatatgtaaggtgcctggaaacatatcatctacaataatgtctcctaaacagaggcgatgcttttctgttaggatcattacagaagatagattattcaattcagtagacatgcactgatggcctgccatgttacaggaaatatctggggtgctggaaattggaagaccaaccaacaacacgtggtactttccgtgggggctatcacactgtggtggggtggagagatccttaaacagaagagcagctgaagtgcaaaggagaaacacagggaagggagccatgggaataaaaaacaatgaatgtagtggccaaagggaaggaagaatacatccttaaggtatgtgccttctatgccgattttgctgagggatttaatcataaagcgatgccggattttgtcaaatgcactttctgcatctgttgagatgatcatgtgacttttgtttctaattctgtttatgtggtgtatcacatttattgacttacgtatgttaaaccatccctgcattcccggtatgaaacccacttgatcatagtggattgtttttttgatatgctgttggattcagtttcctagtattttattgaggatttttgcatctatgttcatcacgtaacataaacctataatgtttaatcaattctccaaaggaaagaataaagagataagccaaggaatacatgaaaactgacagagagaagcaagtacaacaaaatagagtaatgtaaatccagaaagacaactaaagtacaatggcatcccccaaataaacacatagaccgagggaaaaaaatgcagagcccagaaataaatccatgcacttataatcaaatgaatttgacaaaggtgtcaagcacacacagtgagggacggacagccttcaataaatggtaatggcaaaatggtatatccacatgcagaggaatgaaattcaaccctcatctctcaccatataaaaaagtcaacttaaagtaaattaaaaccttataatgtaagacccgaatctatgaaattactagaagaaaacatagggaagaagctccatgacattggtctgggcaatgatttttttgggatatgattctaaaagcacagggaacaacaacaaaagtaaacaaataaaattatctcaaactcaaaaacttctgcacagcaaaataaacaatcaacagtgtgcaaagacactttgtctcctcctccttaatgcctcctccttaatgcctcctccttaaggcctcctccttaatgccgtgttatttcctttgtactgaccacaatatttctattcttttgatgtaaataagaagtgtgactatacttcttttcaatcataaacttgtggttaatagccagaatatcatcgcctactttgggatattttcgacatttccaagtgcagctgtggttgttggaatgattggtaggggctactggcatttggggactcagtgtcgcagggaggcaaacatcttttgccagagtcttcaataaaccggattttccatacatgtcacttcactgtaaactgagggaggctggtatgttgcttcatctgggaagttatgaaagacttactgactccattggaagatcacatcacttcaggccattccattcttggatcccactctgacacaacatgccagtatcagtttgctttgtagctctgcatgcccgagggaaacaatgaagggaatccatcttacctaccaacaggatcttttccaggataagcttcaccacacaccccagctggccccaaaccacttgttattgttgtttcagaaagggtctgttgctctgcctggagtgcagtggagaaaccatggctcactgcagccttgacctcccaggctcaagtgatccttccatctcagcctcccaagtagctgggaaaacacacaggttccaccacccctggccatttttttatttttttgtagaggtggggtatccttatgttgcccaggttgatctcaaactcctggattcaagcaatacttatgcctcaacctcccaatgtgctgcagttaggggcatgagccacctcacctatccctgaaccactttttttttttttaatcacagaaaccaagatagaggaagaaggagcctgcaagccctcctggggaaaattgtgtccttcttcatgctaccctgctatttcctctgcaccaactccaacattcctattttttgatgtaaataagaagcttgaggatactttgtttcaatcataaacttgtggtttattgccccaatatctttgcccactttgggtcattttggaaatttttgagggcagctgcagttgttggaatgattggcaggggctactggcatttggggactgagtgttacagggaagcaaacgtctttttccagagtcttcactaaactggattttccatacatgtcactccctttaaaccgaggggggcctgtatgttgcttcatctgggaacttataaagacttattgactgcttgagaaatcacatcactgcagcgcattccactcttggattctactccgacacaacattccggtatcagtttgctttgtatgcgtccattcctggagaaaatagaaaaaggggaatgcaacttacctatgaacgtgaccatttccaggataagctgttagctgatggggaaacttaagtgggagatgttggtaatgtgatctctcatgagttggtgaacacactggctatgcctgttgctgtaactgatgttgcatatgtatgtccctcaccaggctcccagtgccttcctgaaggctggaaacataccctatagatctctgtatcctcaggatggaacagaggacctcacatacagaaggagagcagggaacacttgtggaatggtagtgatctgtacatggttgggtgaccaaaccctgagtcacagtgatgagccccatggaggtcagtctgcagagggtgggaggagaatgccatgcagcagagtgagacgaacctgcagtactaatctcagttacgccctttaagcatcccagatgtaagcagcctattggttagggttcccgtgtgtgtgtgtgtgtgtgtgtgtgtgtgtgtgtgtgtgtgtgtgtgtgtgtgtagagattgagagagagagagagagattgagtttgaagacctagctcatgcaactgttgtgaatggcaagtccaaatctcacagagctggatgtcaggctggagagcctgggcagaggtgatatgagagctcaaatccaagggcagggtggaggcagaatttcttcatcttgaggaggaccccagtcttcttctctgaaggccttcaagtgactgattgaggcccacccacattggggaggtttacccaaagtctgctgatttgaatgctacttctcttgtaaagaaaaccctccacggagacatctaccctggtcaaagtgaacatttctcatgcattgtgacctagcaaagttgacacatcagatttcccatcatagccatcttatacaaatcctattaatgatgaaggtgtatctgacaaaggcaggggacttcctaagattctgtattaaccatttttatccagcccaagccagcatttctggctcagcacaactccggccaggaagctgaagctgatgtgaatgccttccagcaataagggagtgatgggctagtcagggcacacaggcaatcccagagggcacaggtggtacccctggacaacaagagtttacccttgttagggcacccccagcaggacatacagtcatcaggcaggagctggccaaggcctccattgtggcatcccacaaagaaacctttccctctagggttccccgttcagtctaaaaaattgatttgcatctttggtgactctcagtccattctggaaggtgggaagagagccagccagcagcattaaagccctactgtgtggcagggaagaagctagggaaagtccctcattttctgtcagttagccatggcatcaaccaggacagattatcattcccacttcccagatccagcacacaggaagcggctccagctgaatggcagagatgcctagctgagtactgccagaattccctttttatcttttcctaggccttcaatgatactgccaaatacttctctgagaaagaatgggaaaagatgaaagcctcagagaaaatcatccatgtgtatatgaagagaaagtatgaggccatgactaaacagggtaactgaaagttctaggtacagacaagtctggggacacatgagcatcccttttcctgctttggctacttcttaggctgcagaaagtaccccacattttccttttgtgcagggaaaaatcgcaaggcagcttctgggtgctctgctcttctgtattctgtcagggctgagggcagggactggccacagtggagctcatacctggatcctgcacgtttctctcccttaggagtctgttgtgatgagcccaactgtctctgtggcatcccaggcctcccccaccccgccaccgcccccaacacacccaccctaccttccttctctcggcttgtctctctctctctctctctgtcttttttttttttttttgagtctgagtctcactctgtcacctaggatagagtacagtagtgcaatcatagctcactacagccttgaattcatggcctcaagcaatcctccagccttagcctcccaaagtgctggtactacagacatgagccaccatggcaggcctaagcgtgtctcttaaggaataaatattttgcttcttactaggtttcacggctaccatcccaactttcatggatgacaaaggggccgcagactgccaggggaatgattttgataatgaccataactgcgggaatcagggtgagtagatgggaaggggctggaaagggtctcctcaagcccaactgcttttcagctcagctacctgggaaagagcctcaggcatttgttccctcatacacatcagggctgagtgaaaaaaaaattgcatgcagaaagttaactacagaggccattcatataaaattttaaaacatgcaaaacaagaatatatatttttatggataataagtaaatggtaaatgtatacaaacatgaatgtgaataaaaagccatcaaattaaggtgactggctgtaagtggaggagggagggagagcagggattgctgagtgctgcacacacagcttcagctgtgacttgtcgatagtgtgttttgtttgcttttgtttttgagatggagtttcactcttgttgcccaggctggagtgcaataaggcaatctcagctcactctgactttcacctcctgggttcaagtgattctcctgtctcagcctccagagtagctggggttacaggtgcccgcccccacacccagctcattttttaatgtttggtagagacggggtttcaccatgtaggccaggctggtctcaaacttcctgacctcaggtgatccacccgcctcagcctcccaaagtgctgggattacaagtatgagctaccacgctcagcctgtttgcagtatttctaatattctgaataaataaatcagacctaacatagctgggggtaatgttgagatccgaccagactcaatattattccccatacttttctgtttgaaatatttctttttaaaggacatgttgttcttcctaagcactgttaatgaatcaaaggacagttaagaaaatgttaaaagtgacaaaaaaagaaagaaactgttaaaactgtggatccgccaaaaacttcaagaggttgtttcattaacagcaagtaggtattggataggtatcttaggagtgagggtgatgaacacattatgtaataaagatcgctgtttttctgtatcttatcaaaaccaaatactcttctcattcccaaacaaccccaattctccgtgatgagcttggaagagagtttgaaagagtgatccctcatccaacacagagagagctttcccacttgtcagtgagcagagataacatggggtgaaaaaaagaaaggttcttggctagacatctttgtacatttcaggaatataaaggggacatatgtgtttactggctcttctgctctgacaacacaaatatacgacaaggtcagaatgtccaaaccgtctccaatagaccgataactccccaactaaacaggccagattctttcaactcccacaatcactataagagatctgaaatcaggtagcgtgatgcctccagctttgttcttttggcttaggattgacttggcgatacgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcactgagcagtggtttgtagttctccttgaagaggtccttcacgtcccttgtaagttggattcctaggtattttattccgtttgaagctattgtgaatgggagttcactcatgatttggctctctgtttgtctgttattggtgtataagaatgcttgtgatttttgcacattgattttgtatcctgagactttgctgaagttgcttatcagcttaaggagattttgggctgcgacgatagggttttctagatatacaatcatgtcatctgcaaacagggacaatttgacttcctcttttcctaattgaatacactttatttccttctcctgcctaattgccctggccagaacttccaacactatattgaataggagtggtgagagagggcatccctgtcttgtgccagttttcaaagggaatgcttctagtttttgccaattcagtaggatattggctgtgggtttgtcatagatagctcttattattttgagatatgtcccatcaatgatactggtaccaaaacagagatatacatcaatggaacagaacagagccctcagaaataacgccgcatatctacaactatctgatctttgacaaactgacaaaaacaagaaatggggaaaggattccctatttaataaatggtgctgggaaaactggctagccatatgtagaaagctgaaactggatcccttccttacaccttatacaaaaattaattcaagatggattaaagacttacgtgttagacctaaaaacacaaaaaccctagaagaaaacctaggcaataccattcaggacataggcatgggcaaggacttcatgtctaaaacaccaaaagcaatggcaacaaaagccaaaactgacaaatgggatctaattaaactcaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaacaaacaaccccatcaaaaaatgggtgaaggacatgaacagacacttctcaaaagaagacatttatgcagccaaaaaacacatgaaaaaatgctcaccatcactggccatcagagaaatgcaaatcaaaaccacaatgagataccatctaacaccagttagaatggcaatcattaaaaagtcaggaaacaacaggtgctggagaggatgtggagaaataggaacacttttacactgttggtgggactggaaactagttcaacccttgtggaagtcagtgtggcgattcctcagggatctagaacttgaaataccatttgacccacccatcccattactgggtatatacccaaaggattataaatcatgctgttataaagacacatgcacaagtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcggtaaactatcacaagaacaaaaaaccaaacaccgcatattctcactcataggtgggaattgaacattgagaacccacggacacaggaaggggaacatcacactctggggactgttgtggggtggggggaagagggagggatagctttaggagatatacctaatgctaaatgacgagttaatgggtgcatcacaccagcatggcacgtgtatacatatgtaactaacctgcacattgtgcacatgtaccctaaaacttaaagtataataataataaaataaaataaaagagatctgaaaatccagtgcttgaatatctgccaagtttttgacaataaaggagtgtctttatactgaaaatatttcagagccactggactaaatcatccatggttcatcacacatttaacagcttaattcacataccacagtattcacccattttaagtgtacaatgatttttagttgttgtacatttgagtgaatatagttcagattcccaaccaatcaatttaattatttgggtaaaagtaaaacatatgtaatggaataagatgagactgtgatggggtttagtccaatgtgatgaaccatgagatggaaaattctgaattgatgccaccgataaatgaaccaaccatgactaaacataattcagaagcgaatctccaataactcctcaacaatgagtggactcataaccctctgctgcagaatgccctcatgcaatagaagtctctctagagtttggaaatctttaccaacaaagaaaaattctgatgtattctctttcagttgaacgtcctcagatgactttcagcaggctccagacttcgtgatctgcacacctcggcctcccaaagtgctggctttacaggcatgagtcaccgtgcccgggtgatttcccatgctctttctactccctgtcctgtatatctaagggatcctccctacccaggatgctgtgggctcccaaaccccaggtcagccctgatatgcgggccacaccttcctctagcctagaaattgataacccaggcgaggaagtcactttgacatgagcagatggttcacttcgaggaaccatggaaggcgtgtgcaggtcctgaggtaggacagaatcggagtgtgccgggtctgcaggtcaggaggagttgagattgagttatcaggcagtgggaactcatgccacttactttccttatctcctcttgcctcagcctcggggatatgacacatgcccatgatgagaaacagaacatggtcaccattcacgaacgtgggcatgtctgcggacccctcgtcatcaggtgcatagcaagtgaaagcaagtgttcacaacagtgaaaagttgagcgtcatttttcttagtgtgccaagagtttgatgttagcgtctccattgtattttcttacagtgtgctgttctgttagatattatccttttcattgatgagcaaggcatacttaatgcatatttcggtttgtgtatccatgcacctaccttagaaaacaggtattatcaggtattctctgcatagaacagtactaccctcctctctccccagatgtgactactgagggcagttctgagtgtttaatttcagactttttcctctgcatttacataccacaccacacacacacacacacacacacacacacaccaagtaccactataagcatctcacatctgcttttctccattgccatgtgtcctggtcaagcccagctcactctgtttcctgttcagcatgtactcccctcatcagattcccctgtatcagtcactgacgtttaagaaacctttgcaacattgcatccagtttttcacattcgctggcttacagaggctgacagcttagacccacaccaatacaggccaaatgccaatgaaagttttagcttctggctccttccgctgtcaggtttagattcccaacctcttcacttaagggaacattcacctatacctcctttcattcagcatgtatttaagggcacacaggcataccttgttttattgcacctcatttttatagtgcctcacagataccgcaattttgtttttgaaattctcaccaattttacacttttccattattattatatctggtatggtgatctgtcatcagtgagctttgatattgtgattgcaattgttttgttgttctttagtgttttaaatcttggttttttatttttgtgggtacatggtaggtgtatattcttatggggtacatgagatgctttgatacaggcatgcaatgcgtaatactcacatcatggaaaacagggtatccataccctcaaccatctatccttgtgttacaaacaatccacttacactctttattttttttaaatgtacaattaagttattattgactataatcacccagttgtgtgtcatggttttgggggtaacaggaactgcgcccataggagatgacgaacttaatcgaccaatgttgtgtgtgttctgactgctccatcgatgagcgcttccctgcctctcttccttttcttgggccttcctaattcctgacacacagcaacactgaaattaggatgactaagaaccctacaatggccgctaagtgttcaaatgaaacgaacagtcacatgtctctcacattaaatcggaagctagaaatggctaagcttagtgaggaagcatgctgaaagccaaggtaggctgaaagctaggcctcttgcaccaaacagccaagctgtgaatgcaaaggaatagttcttgaaggaaataatagtatataatgcaaagggaaagttcttgaaggaaataataatactaatactccagtgaacacactaataagaaagcaaaattgccttactgctgaaatagagaaagtttaggtggtcaggatagaagatgaaaccagccacaacattcccttaagccaaagtctaattcagagcaacacccaaactctcttcaagtccatgaaagctgagagaggtgaagaagctgcagaagaaacgtgtgaagctagcagaggttggttcataaggtttaaggaaagaagccgtctccataaaataaaagtgcaaggtgaagcagcaaaccctgatggagaagctgcagcaagttatccagaagatctagctaagatcactgttgaaggtggctacagtaagcaacagattttcaatatggataaactcgccttctaatggaaggagatgccatctaagactttcatagctagagaggattgactccaactttgaaagaagttctactgtgggtaaaatgctgtccaatagcaccacatactacagagatatgcttcacgaaagggagagctaatcgatgtggcaaatttcactgtgttcttttaagaactgccacggccactccagccttcagcaaccatcaccttgatccaccagcagccatcaacaccgggacaagaccctccaccaggaaaaagagtgtgactcactgaaggctcagaagattgttagcatttttaacaatgaattattttaaaattaagttatgtacatttttagacataatgctattgcacacttagtagactacaggatggtgtaaacgtgtttttacgcactacgaattcaaaaaagaaaaatgtgtgtgactctctttattgcagtggtctggaaccgaacctgcaatatctctgaagtacacccgtattgggtatcaggcattgagctgagtaagaaatgatcccaggtaatcaccgatagaattgcttgagcaccttccatatcatcagaccttctagatttaatttaatacctccaaacgatttatgaactatgattctttatttccatcttatggactaggaatctggagctgagaaaatttggaagacttgccccaaatcatgtggttttttatatggatgacaactccagtctgtgtttctggaagtcacgttagacatggcttcatctggagctgggcaagctcctctgcccagcctggacccaggcttgtctgggatcaatgccacacacccagtccacacacctgaaaatagccagaaaagccagaggggttgttcccgaattctttcttcttaccagatctcttgtgaatcttctcagaagtatttgctcttcttggggggcgcagctgtttcccatcgttttgtgggccagatgcttctggcactcccttcgaatcatttccttcctctgctgtcttcttgggcatgatcattataatgtgaaggtcacagataaacagtatcagtgacatttctatagtgtttcagagcttacaaagtgtcttcacatgcattaccttaatcaatgttctcaataacgctgggagagttacacttgcctaaattaggagaaacctgggaggtcagaagggaaaggaacggcccaaatgaatggggtttccagggctagaatgcttatcttcacactcttttaagactgacattcttgcaaacagcaaaaatctccatgtagttgagagtttgttatacaggagatttggagaaaaatagcattctaagaattcacaagttctacaaggggaagaggttctataaaatacaagggatcccatataagcttgtagacagctgctgggagagtaaatgtaaagacatagagaggggacaaaacactgctgggaaagatggtgtggggagattaatacagggaagggagagggaaagaaatggtttgctgaaattaatctaggcagcaaacaaagcagtatcacatatggcataccaccctaccgaggcaccaacattgaatgtggaattaagtgaggtggttcccataacaattctggttgctttgggatgtgtcactgacaaagctatttttttttttttttgacgcagtcttgctctgtcgccaggctggagtgcactggcgcaatctcagctcactgaaacatgcaactcccgcgttcaagcgattctcctgcctcagcctccctagtgtctgggactacaggcaggtgctatcacgccccactaagttttgtatttttagtagagatgaggtttcaccatgttggacaggttggttttgatctcttgacctcgtgaactgcccgcctcggcctccgaaattgctgggattacagtcgtgagccactgcacccggtcattaagctactttttattcagctccctcacttatgaaatagtgaacaatacatgtaaaataggctaagggaaagtcctctctgagcttgtaaacacggtttaaatgtagtaataataacaattaatacctttctgaatccttctttgaattcggtctccatactggtaacccaactcctagatccctttaccctctaaacaagagttgaatctgcagttgtggggtcactcattcaggggcctccgaggtatcccctgggctgggacgggggattcccggatgtcccagctgcaggcaaagccctcaaggagctcacagtagggaggggccaacagtcaaagcgattcttaagccatgccagtggccccagtaacagagctgaggccagctggtccttcctgttgtgagagtggatgtctcaatggaagcaccagcaggccctatggggtaaagccctagtgagcaacatctgaacttcataacaaatgcaaacgtgaatgaactttaaatggcttggagctctggattagactaccactgccactgcgcctcaggaaaattctttaacatctctgtaccccgatagcctcattttattattatgttgctgatagctatgatctaaaacatgaactgtgattctttacttccatttcatggaccaggaatctggagctcagagaacttagaagatttgcaccaagtcacatgacttttatatggatgaaaactcaactgtgtgactcgttattatttggagataataacagacacaacgtcacagaggtcttcttagggattaaataaattcatccatgtgaactgcttaaaatagtatctggcatcactatgaagacaaaagaagtaataaggatcacaactgttagtattatcaaaccgttggtgctacaccaggttttgtgatagatatggggagaaggaggcaatgagggcatttttgatattctcccactcttaccagtgttcacatccatgaagggacaaaggttctctggtccattagatttgagagatactcaccttcgggaagattctctggagcctgctgaaagtcatctgaggacattcaactgaaagagaatacatcagaatttttctttgttggtaaagatttccaaactctagagagacttctgtcgcatcagggtattctgcagcagagggttatgagtccactcattattgagaagttattggagattcgcttctgaattatgtttagtcatggtttccatctcatagtttatcaaatggggactaaaccccatcacagtctcatcttattccattaaatatcttttactttttcccaaataattaaattgattggttaggaatctgaactgtatccactcaagatgggcaacaactgaaaatcattgggtgattttcaaatgggtgaatactgtggtatggatgaatactgtggtaaatgggtgaatactgtggtatgtgaattaagctgttaaatgtgtgatgaaccatggatgatttagtccagtggctctgaaatattttcggtatgaagacactcctttaatgtcaaaaacttggcagatactcaagcactggattttcagatctcttatagtgattgtgggagatggtagaatctggcctgtttagttggggagtaataggtctattggagacagtttggacagtttgaccttgtcttgtaattgtgttgtcagagcagaagagccagtaaacacatatgtcccctttttattcctgaaatgtacaaagatctctaccgaagaacgtgtctttttttcactccatgttatctctgctcactgacaagtgggaaagctctctctgtgttggatgagggatcactctttcagactcactcccgagctcatcacagagaatcagggttctttgggaatgagaagactatttggttttgataaaatacagagaaacagcgatgcttattacataatgtgttcatcaccctcactcctaagatacttatccaatacctacatgctgttaatgaaacaaactctggaagtttttggcggatccatagttttaacagtttctttctttttttgtcacttttcacatttcttaactgtcttttgattcattaacagtgcttaggaagagcaacatgtcctttaaaaagaaatatttcaaacacacagaaaagtatggggaataatattgagtccagtcagatctcaacattaccccacagctgtgttaggtctcattttttcattcagaatattagaaatactgcaaacaggctgagcgtggtagctcatacttgtaatcccagcactttgggaggctgaagcgggtggatcacctgaggtcaggaagtttgagaccagcctggcctacatggtgaaaccccgtctctaccaaaaataaaaaaatgagctgggtgtgggggcgggcacccataaccccagctactccggaggctgaggcaggagaatcacttgaacccgggagttgaaagttggagtgagctgagattgccttattgcactccaccctggccgagaagagtgaaactccatctcaaaaacaaaagcaaacaaaacacactatcgacaagtcacagctgaagctgtgtgtgcagcactcagcaatccctgctctccctccctcctccacttacagccagtcaccttaatttgatggctttttattcacattcatgtttgcatatatttaccatttactaattatccataaaaatatatattcttgttttgcatgttttaaaattttatatgaatggcctctgtagttaactttctgcacgcaattttttttcactcagccctgatgtgtatgagggaacaaatgcctgaggatctttcccaggtagctgagctgaaaagcaactgggcttgaggagaccctttccagccccttcccatctactcaccctgattcctgtggttacggtcattatcaaaatcattcccctggaaatctgcggcccgtttattatgcatgaaaggtgagagggtaaccttgaaacctagaaagaagcaaaatgtttattccctaagagagaagcttaggcctggcactgtggctcacgtctatagtaccagcgctttgggagactgaggtgggaggattgtttgaggccaggaactcgaggctgcagtaagctatgattgcactactgcactctaggctaggtgacatggtgagagtctgactcaaaagagagaaaagccaagagaaggaaggtagtgtcggtggggggttgccaggatgccacagagacagttggactcatcagaacagaggcctaatggagagaaacgtgcaggatccaggtatgagctccactgtggccagtccctgccctcagccctgacaggatacagaagagcagaacacccagaagctgccttgcgatttttccctgcacaaaaggaaaatgtggggtactttctgcagcctaagaagtagccaaagcagggaaagggatgctcatgtgtccccagacttgtctgtacctagaattttctgttacctagtttagtcatggcctcatactttctcttcatatacacatagatgattttctccgaggctttcatctttcccactctttcttagagaagtatttggcaatatcattgaaggcctagaagaaaaaaaaaaggaattctggcagtactcagctaggcatgtctgccattcagctggagccgcttcctgtgtgctagatctgggaactggggatgataattcttcctggttgatgccatggctaactgacagaacaaggggcacctaccctagcttctcccctgccacacagtagggctttaatgctgctggctggctctcttcccaccttccagaatggactgagattcaccaaatgaagtgcacagtcatagacttgtctccagagatgctaggtgatgacagagcgagggtgggaagttcccaaggatccagatctcccccgagaccctgctccttgtctccagtgtctctgtcctcccctcctcagaaaccaggtcaccccacactgtcccctgggccactactatgccccctccaggtcacctcagcttttgtatcttctctggtatttgagcatcatccctagctctctttgcacagtcgttgtctccgttcatggcaccgggactagtctgacctgcaagagaaacagaatgagactttccagccacaggacctttggtcttgtggagggagaaatcagtgaaggccggccacactcagtcacctggaatcaggtgctgcatttctccatccggggcttatctgttcctgagtaaggccatggggagaagtcagatgaaaacaggaaaccagggatctctgggagaagtattgattggggataacaggtttcctatgggcaaagcagccttgagtctttaggagggggttggctactcttgttagtagtttccctggagctagccttgccctgaaagatgtacagacccttgttggggaggcaaggacatgactatgtaattgtattgggtgagggcgtgctgaaatatggggtatttcaagatgcagcaatcagccaggagcagtggttcacgccagtaatcccagcacattggccaatcctcccgcctcgatcttgggactacagtacaggcatgcaccacccagcccctactaatatttttatttttgttttttttagtggagagggttttgctatgttgaccaagttggtctcgccctcttgggctcaagcgatactcccgcctcagcttagggactacaggcatgcaccaccctgccttttgctatgtttccaggctggtcttgacctcctgggctcactcaatgacttgaacctgggaagcagaggttgcattgagccaacatcacaccactgcactccagcttgggcgacagtgcaagattgtcaaataaatagataaataaatacataagaaagaaagaaagaccagctgaatctccataagaatagtagtaagctttgtggtatttttacttaccctcatcccatctcatgctcccagcttggttctgttcattgctgatgaaatacagataggattggccagaactggtagagggctggctgttgatcatgaaaatgtcagacctgatatagtcctccttggaaaggccctttctaggggctgatactctgtgtcagtggtgctgtgagacaatgacataatgctgaccattaagccaggggaacgtgggtccacatacggtggcaatccactaggctgctgagtgaccatcgcagcccttgaggttttagaagaagaaaaccttgctgaaaatgcagaaaaaaaatgggtattctcttgagaaatgaacccatgaagctaccttctgatgttgtgactgccgtaagaggaaaatgattgttttatttattcatttagttattttattgagtcagagattcactccggttgcccaggctggagtgcaatgccacgattttggctcactgcaacctctgcctcctgggttaaagggattctcctgcctcagcctcctgagtagctgggattacagggatgtgcccctatgcccggctaatttttgtatttttagtagagatggggtttcgccttgttggccaagctggtattgatctcctgacctcaggtgatgcacctgcctcggcctcccaaaatgttggggttacaggcgtgagccactctccctaggaggaaaagaattattaaatgctattgttattcaagacaacaaagactgtgatgcttggaaggtgtatctacaacttcgagattatggatttctggcccagccaatccatggtgacatcatcagtttttgcctctgctagtggtcaaggaggatgagattcgagagtccagtgaaatcaataacaagaccatcttgtcgttctgagtgtagcagccattttcagtggtccctgggagccgactagagacaggtggtcctgtaaaagctctgctcttaatgtgggcacattccactcccatgtgtcttcaaaacctttttctggaatatatttttttttcagttgatacataatagaatagtgtttatgaagctgccttttgctttgtaacataagtaagagaatgtaatggcatctatattcagtgaaagtgttttgatgtgcagaacatggcgaggtgcagtggttcatgcgtgtaattccaggattttgggaggcaaggtgggcagattacttgaggtcaggagtttgagaccagcctggccaacacagagaaaccccatctctactaaaaatacaaaaattagctaggtgaggtggtgggtgcctgtagtcctagctacatgggagactgagacaggagaaccccttgaacccaagaggcagatgttgcagtgagccaagatcatgccactgcactcaagcctagatcacagagtgagaatccctttggaaaaaaaaaaggtacacaacacttccatcaccacaatgctattccttgtgctactcatttttagtaatactcactctcctcccacccaccattcctaacccctggcaaccactaatctgttttccacttctacaattttgtcttttctagaatgctgtacaaatgaaatcttatagtatatcacgttttaagggcttattccactcagcataattccctggagattcatccaaactattaatatctgtgtatcaatagttcattgttgctgttgttgttgagacagagtctcactctgtcactcaggctgcagtgcagtggaatgatcttggctcactgcaacgtccgcctccctggttcaagtgattttcctacctcagcctcctgagtagctgtgactacacgtgcatgccaccacaccctggtaatttttgtattagtcatagagacggggtttcaacatattggcaaggctggtcttgaactcttgacatcatgatctgcctgcctcaacctcccaaagtgctgcgataacaaggtaagccactgtgcctggccaatagttcatttttattactgagtagtattccataggatggatgttccacagtttgaccattcacttattgtaggacatattgattatttccagctactggctattacaaataaagctgctatgaacaattatgtacaagtttctggataggcatacattttaacttctctgaagtgtaattgttgaaatgtatggtcattgcatgtttagttttgtcagaaactaccaaactgctttccagagtggctgtaagattttaccttcccaacagcacttaatgaggtgtccagtttctctgcatcctcgtcaccatttggtgttgtcactatgtgctttatttcatctattgtaataagtgtgtagtgatacctcaccatggtcttaacttgcatctagtgaaggaaatgagggttgaacatcttttcatgtgcctatttgcttatttcctcttcagtgaagtatatgttcacatcttttcatgattttctaattggattatttgtttgtattttttaccattgaggtttattattattattactattattattattattattattgagacagagtctcactctgttacccagactgcagtgcagtggcacgatcttggttcactccaatttctgcctcccaggttctagcgattctcatgtctcagcctcctgagtagctgggattacgggcacgcatcatcatgcctgtctaatttttgtatttttagtagagatgggcttttgccatgttgcccagactggtcttgaactccaggcctcaagggatctgccctccatccacctcgacctctcaaagtgctgggattacaagcgtgagccaccacactcagcataccattgagttttgagagtactatacatatccattatatattctggatgtgagtcctttcttggatatgtggtttgcaaacattttctcctagtcaagacccagttttttcatccttttaacagggtctcttgcagagcacaagttttaaattggatgaaatctaatttacttgttttctttatggattatgctttttgaaccattcactataccctagatctcagacgtttgtcccatgctttcttgtaaaagatttttttttagttttatattttagatttaaatctatgatccacttgagttattttttgtataaaaatatgaagattaggtctttttttttttttttttagcctatggctctgcaactgctccagcaccatttgtcaagcagatgacccttccttctttttgtccctgtaaaaaatcattgtggggctatttctaggttctctattttgttccagtgatctatgtgtctattcttctcccagtactacacagacttgattcctgtagctatataagaaatattgaaatatggtagagccattcctcccaccttattcttcctttccaaaaattgtcttagctacatatatatatattgagatgcagtctgacttgtgttgcccaagctggagcgcactggggtgatctcggctcactgcaacctccacctccagggttcaagtgattctcctgtctcagcttcctgagtagctgggattacaggcatgcgccaccacacacggctaatttttttatttttagtagagagggggtttcgccatgttgaccaggctggtcttgaactcctgacctcaagtgatccgcctgtcttggcctcccaaagtgctgggattacaggcctgagccactgcgcccagtgttgtctaagctattggaaacttgttacagcagcaatcaaaaatgaaaacacatggaaacatttattagtgaaacaaaatagaaagtcaaaaaacagactgatctatatgcaaacttcagcatgcatttccaaacagtgggcaacagatgatgggttgtataataaatgattgcttgacaagtgtctatccatttcaaaaactaaagatgaaatccttactttgaagcatataaaataataaattctaaaaattcagtgacttaaatgtgaaaacgtgaaatcataaagaactagatgaaaatttaggaaaatattacagtgtaagacatcctgagttggcataggaacttcctgacattactccaaggctataaacaatgaatctgacataaagatgcaaaaattaaagtatcatctaattcaaaagacaccataaacaactgtttaaaaaggcaaatgttggggaaattggtgaagcatccccaataaactaacagtaactatctctaatatacaacaaagcttttgcatatcaataagagaaactggaacaactcaatgaaaaaatgtgttcaggcatggcactacttcactgtatagcacaaaaggattatgaaatagaaagtataaaagaaaaataataaaggaaatggagaatagatcccagaagtttcaaagttcatccaacagaagttccagagataggccaggcacggtggctcaagcctgtaatcccagcattttgggaggccgaggtgggcggatcaactgaggtcacaagtttgagaccagcctggccaacatggtgaaaccctgtctgtactaaaaatacaaaaattagctgggcatggtggcacgtgcctgtaatcctagctgctagccgtgctgaggcaggaggatcacttggacctgggaggcagaggttgcagtgagccgagattgtgccactgcactccaacctgggcaacagagcaagactccgtcttaaaaaaaaaaaaaaaagttccagaggtagagaatagaaagactgggccgggcgccatggctcatgcctgtaatcccagcattttgggaggccgaggcaggcaaatcacctgaggtcaggagtttgagaccagcctgattaacagggtgaaaccccgtctctactagggtttggtggtgggcgcctgaaatcccagctatttgggagttcagaacagttcccagtaacaaaacccttgatggtttggccccactggggagtgagatgtcttcgagtgggaaaaggtcagaggccacagatggaggatcagcccagttggagctttctaagttacattctttttttctccttgttttctcgatggcttattacctgttctgtaaacatacagagcagacacttggcagggctggcccagtggcagccgaaagtggcctgataacattaaggaatagggggcttggaaagctcctagagaaagtgcagactcatcaaagctggccagtaactgagcattcctttcctacctctttctctgccctctgagctaggcaattacaaccaatatcacccatccatagactccctccacactgtaaggcagaaatcctataagcgtctctgggggctcataggctagggactggaaagaagaattggctcagctcagctctagaggctctatatcctacgacctatcaatccagaaaccctgaaactcatatggagtgtctgggctgacacatcttcccaggaacaaagagttatacagaaaaactatcggataggcctggcatggtggctcatgcctgtaatcccagtattttggaagaccaaggtgggacgatcacctgaggtcaggagtttgagaccagcctggccaagatggcgaaaccccatctctactaaaaatacaaaattagctgtgtgtggtggtgcacgcctgtaatcccagttactcaggaggttggggcaggagaatcacttgaacctgggaagcagaggttgcagtgaggcgagaccacaccattgcacttcagcctgggcaacaatagtgaaactgtcttaacaacaacaacaaaaaaaggccgggcatggtggctcacgcgtgtaattctagcaccttgggaggctgaggcgggcgactcacctgaggtcaggagttcaagaccagcctggccaacatagtgaaaccctgtctctactaaaaagacaaaaattagctgggcgtggtggtgggcacctgtaatcccagctactcaggaggctgaagcacaagaatcacttgaacctgggaggtggaggttgcagtaagcaaccttgcttactacagtggctggatcccaccactgcactccaacctgggcgacagaggaagactccatctcagaaaacaaaaacaaaaacctaataaatgcagttaggaaactatcttaaaacacaaaatccccgtttttttagactgattgtttaaaagataaagaaaaacagatcaacatgttaagaaaacctatttcaaaacgagaggagtagactcaccctgctgcagtgcacccttgacactaatggtcgatttttagataaacggataaacaatttcttttcaatcacaaccaatctgatcatatataagactcccttcccaaggctcatccttcataaaccctcagcaacttgcctagaaagtccatcattttttatgcccagtcttagtcccataatttttcatttttatattggactccaattcaagttctagtaaaatgttagaggaaaaggataaactgaggaaaggactgttaagcaaaaaggatccagggaaattctcagcctatcaagattgcaaaagacactaaaattaggagaggcactgtcaggaaggtatgctctagagagaaagtcaagaatgtggccatgtttgctagtgctgaagagatcaggcacgtgactcaaggagctcttccactatgctcagccatagctggtaatagaaatgatattatcttggaagctacacaaaggacctgctggcctaaaggtgtgaatcactatgacatacattctgagaggagggctatgggaccagaggggagagcttcaagctacagaggattattctgagtacttgaaaccaaatggaatttgtcctgctagatttcaaaatggttggaagcggtgactcctttcttccagtttctcccatttgaaatggaagtatctgtaactattatcctacacctgtctcgccactttatttttggaacagataacttgttttctagtgtcacaaattcacagcaggagaattttgccccaggatgtttcataaccagagtctcacccatatctgttttagatgaggagatttggtaattttgagctgatcttatatggataaaatgttggacttcagctaatgttgcatggtttgagacatttgaggatttggggatggggtgcatgtattttgcatgtgggagagatgtgaatccttgggggccagagggcaggttgtggtagactgaacaatgcccctccaaaagatagtgacatagtaacccctggaacctgtgagtgctagcttacaacaaaaaaagtgattatgttggccaggtatggtggctcacgcctataatcccagcactttgggaggctgaggcggatgggtcacgaggtcaggagttcaagaccagcctggccaagatggtgaaaccccgtctctactaaaaaaaatatataaaaattagctgggtatggtggcgggcacctgtaatcccagctacccaggagcctggggcaaagaattgcttgacctgggaggcagaggttgcagtgagctgagatcacgccactgcactctagcctgggtgacagagtgagactccgtctcgaaaaaaaaaaaagtaattatgttaaagctcttgagatggggagattctcctggattatctgggtggcccctaaatgtaataatgagtgtccttatcacattgaggcagggagatctgacacagacagaagagaagacggcagtatgcctgccatggtttgaacgtccccaccaaaacttgtgttgaaatttaattgccattgtaacaatattaagatgtgcggctgttaggaagtgattaatgccattatcataagagtggattagttatcatgagactgggtttgttataaaagggagcttagccacattttctctgtctgtctcctgcacttgcttttgcctttcatccttccatcatgacacaaccctcaccagatgccagcgccatgttcttggactcctagcctctagaactgtatacgtaataaacttctatcctttataaattacccagtttgtggtattccattatagcaacagaaaacaaacgaaggcaatgaccatggagatagagattagagtgatgcagccatgtattagtccgttctcacactgttataaagaactgcccgagactgggtaatttataaaggaaagagatttaactgactcacagttccgcatggctggggaggcctcaggaaacaatcatggccaaaggtgaagaggaagcaaagactttcctcacatggtagcaggagacagaagtgcaagcaggggaaatgccagacgcttataaaaccatcagacctcatgagaactcactgtcacaaaaacagcatggggaaaacccgccccccccgtggggatttgtaatctgtggggattacaattggagatgagatttgggtggggacacagagccaacccatgtcaagccacaagccaagaaatgctggcaatcaccggaagctggaagaggcaaggaacagattctctcccagagcctctggaggactacagccccgctgacaacttgatttcaactcagtgaaactgatttcagatttctgggctccagaattgtgagagaataaattgatgttgtttatgccacaaagtttgtggtaatttgttacagcagccagagggaatttggggtgattgtaaggagttatgtaaattatgttaaagaaccattgcagttgtaagatgcattcattcattcaacaaatagtcgaggcaatatagaagagtaattaaaagcactgactttgaggccgggtgtggggtggttcactcctgtaatcccaatgttttgggaagccaaggcaggaggattgcttgaggccagcagttccttccagatcagcgggggcaacatagcaagaccccatctctaaaaaatattattttaattaaaaataaataaatacataaataaaagcacagactttggactcaattcatcttgggggtgaatcccagctctgtcacccactgactatgtgaacttgagcacactgcttaattctctgagcctcagtctcaacatctgcacactggggatgataatagtatttaactcaagagaagattgtgaaaatcaatgggaagatgcacataaagggctttgtgctgggctcaagggccattgccctgtccctgccctaacagagcttgctgtcatcctgggaggatcttagagagatcagggctgtagatggaaagcccagagaggaaaggggacttgttggaggtactagggatgggggtaggggaaacttcttagacaaattgacttatgagctccctgatgaacacagtgggccttaattacatactctttttaaaactattattataaatatttttaatatcaatgggtaaaatatatttctgcttctttggtcttttagaaaaaaacatacatagaagtgtagaagtggtttttttgtttaaatttcttttttaaaaatttttttatagagacgggggtctcactatgtatcccagattgttccagaactcctggcctcaagtgatccttccacctcctgcctcagcctctcaaaaagtgttgggattacaggcatgagccactgggactggctcactgaaatttttctttctttctctctctctctctctctttttaaagacaagatctcgctctgtggcccaggtaggcagcagtagccagatcatggctcactgcaacctcgtactcctgggctcaagctatcctcctacctcagcctcctgagtaacggactacaggcacaccaccccacctcgctaattttatttattttatttttttgtagagaaaagagacagggtattgctgtgttgcccaggctggggtgcagtggcatgatcgtggctcactgcaacctctgagtcccaggttcaagagatcctccagctgtggcctcccaaagtgctgggattacaagcgtgagccaccgctcaggcccaaatttcttacgtcactacagagttcctaggaaaaattccatacctgaaaaagttaggaactgacaggaaggatttgagatgatgacctgcttcatatacactccttattaaaactgaacaacaatccaccactgggggggtaagggagataggaaaaatggaaagagaaaatcagcgcatgcgtactctgattttggaagaatctaaagagaaaatcagagcatgcgtactctgaacttggagtagccaatcccaggggatgctttaggcgggaaaatcagagtctctgcctccattttgagaaggttctgtccctggagcctggactgatagaccccacatcagcttggcttttcccacctactgttctgacttctgattggccagatggagttcactaactgccctgattggtccatcatcctggagcagtgacattgcaggatattttctcctcctccagccacactttgtcaccaactgctgccaactcgccaccactgctgccgacctcgccaccactgctttgtctctgaagtaggttctctttaagggacaccctagatgggctaatcggggcagatagaaaaggaggaagcttctgtagggccgtcaagtgcttggggttccgaaaatcttgaggactgaaagacaactaatgcctttcaggacgatcatcatggaggattctcccgccttggccttgggtgtacaggcctgtatcatcccacccctggtatttttgggggggggtattttagtagagacagggattcgttatgttggccaggctggcctcaaccgcctgggctcaagcaatcctcccgccttggcctcgggactgcaggcacgcaccaccccaccctcactagtatttttttatttatttatttattttagtacagatggtttcgctatgttggccaggctgacctcgaccgcctgggcttaagcaatccttccgcctcggccccaggactacagaagtgcaccatcctgcccacgcttttcttttttttttttttttagtagaaaccgtgtttcactatgttggccaggctggcctcaacctcctgggctcaagcgatcctcgtaccttggcctcaggactacagatgtgtgccattctgcccctgctagttttgttgttgttctttttactagagacagggtttcgctatgttggccggactgggcttgacctcctcagctcaagtgatcctcccacctcagcctcggaactacaggcaagaaccacctcgctgatgttatttttttgttgttattactagtagtagaaatggggttttgctatgttggccaggctggcctcgaccttctgggctcaagagatcctcttgcctcggcctccggactacaggcgagcaccaccccgcccccactaatactttttattttattttattttattttttttagtagagggtttcgctaggttggctaggctggtaccgacctcgtgggctcaagcaatccgccccccttgaccaaagtgctgagatgctacaggcctgtgccactgcccccagctaaattttgtgatttttttttttttttgtagaaatgaggggtttgctatgtttcccaggctggtctcatcctcctgggctcaagagatctgcatgcctcggcctcccaaaatgctgggattacaggcatgagccactgtgcctagctgattgctgcaaattgaaacaccccacattttctgtaagtgatggcaggctcatctagtctcagagattctagctctcttccttctaataatttacaaatcaccgagtaatagcctctaaatctgttcatattagtgaaggtcatttctcttcaacagaacagaacccctcaaccctctgcctgatcagatccatcaccagagagaccaggttatgtctgggactcacttccctccctttatttattgagtgggggtgtcagaacgcccccactgaatagttacacagtcacgtccctgcctccccaacaagggtctgtacatctttcagggtaagcctagccccagggaaactactaacaacactagccaaccccctcccaaagactcaaggctgctaggaaacctgtcatccccaagcaatacttctcccagagactccaggctccctgttttcgtctgacttctccccatgtccttactcagggacagataagccccgaatgcagacatgcaacccctaattccaggtgactgagtgtggccgggcttcactgatttctccctccataggaccaagggtcctgtagctagaaagtctcaggctgtttctctcgcaggtgagagtgctcctggtgccatgaacggagacgacgcctttgcaaagagacccagggatgatgataaagcatcagagaagagaagcaaggtgaggtgacctggagggggcagagcagtggtccaggggacagagtagggtgaccaggtttctgaggaggggaggacagaggtactggggacaaggagcagggtctccggggagatctggacccttgggagcctcccaccctcgctctgtcatcacctagcatccctggagacaagtctgtgaccttgcactatatttggtaactctcagtgcattctggaaggtgggaagagagccagacagcagcattaaagccctaatgtgtgccacgggagaagctagggtaggtcccccatggtctctcagttagccatggcatcaaccaggacggattatcatcctcacttcccagatccagcacacaggaagcggctccagctgaatggcagacatacctagctgagtcgccgccaaaatttctttttttttttttaggccttcaatgatattgccacatacttctctaagaaagagtgggaaaagatgaaatactcggagaaaatcagctatgtgtatatgaagagaaactatgaggccatgactaaactaggtaacagaaagttctaggaacagacaagtctggggatacatgagcatcccttttcctgctttggctacttcttaggctgcagaaagtaccccacattttccttttgtgcagggaaaaatcacaaggcagcttctgggtgttctgctcttctgtatcctgtcagagctgagggcagggactggccatagtggagcttgtacctggaccctgcacttttctctcccttaggcatctgttctgatgagcccaacggtctctgtggcattgcagcacacctcccaccctaccttccttctctcggcttgtctttttctctctctctcccttttttttttttttttttttttttgagtcagagtctcactctgtcacctaggctagagtgtagtagtgcaatcatagctcaatgcagcctcgaactcctgggctcaagcaatccttctgcccagccaatggaatagctgaggctacaggcacatgccaccatgcccaactaattttattttatattttgtagatatgggggtctctctatgttacacagtctcatcttgaactcctggcctcaaacaatcctcctgcctcagcctcccaaagtgctggtacgacagacatgagccaccgtgccaggcctaagtttgtcccttaaggaataaacattttgcttctttctaggtttcaatgtcaccctcccacctttcatgtgtaataaacaggccacagacttccaggggaattattttgataatgaccgtaaccgcaggattcagggtgagtagatgggaagtggctggaaaggtctcctgaaacccagttgcttttcagctcagctacctgggaaagatcctctgacatttgttctctcatacacatcagggttgagtgaaaaaaaaattgcatacagaaagttaactacagaggctattcataaaattctaaaacatgcaaaacagtaatatgtattttcatggataataagtaaatggtaaatgcatgaaaacatgaatgcgaataaaaaggcatcaaattgaggagactggctgtaaatggagaagggccgggggcagggattggtgagtgctgcacagacagcttcagtcatgacttgttgatagtgtgttttgttttgtttttgtttttgtttttgtttttgtttttgtttttgttttgaactggagatttgctcttgtcgcccaggctggagtgcaatggcacagtctcagcccactacaacctctgcctaccgggttcaagggattctcctgcctcagcctcctgagtagataggattacaggcacccgccaccatgtacacctaatttttgtatttttagtagaaacggggtttcaccatgttggccaggctggtctcaaactcctgacctcaggtgatccacccacctcagcctccaaagtgctgggattacaggtgtgagctactgcacccaggccgtttctagtgtttctaacattctaaataaataaatcagatctaacatagtcatggggtaatgttgagatgcgactgaactcgatattattccccatacttttctgtgtgtttcaaacatttcttttttaaacgacatgttgttcttgctacacactgttaatgaatgaaaggacagttaagacaattttaaaagtgaaaaaaaggaaaatgttaaaagtgtagatcagccaaaaacttccagagattgtttcattaacagcatgtagatattggataaatatcttaagagagagggtgatgaacacattaggtaataaagatcgctgtttctctgtactttattaaaaccaaatagtcttctcattcccaaacaaccccaattctccatgatgagcttggaagtgagtttgaaagagtgctccctcatctaacacacagagagctttcccaattgtcagtgagcagagataacataggatgaaaaaaagacaggttcttcggtagagatctttgtgcatttcaggaatataaaggggacatatgtgtttacctgctcttctgctctgacaatacaatcataagacaaggtcggagtgtctaaactgtcctcaatatacctattactccccaactaaacaggccagaatcaaccatctcccgcaatcactataagagacctgaaaagccagtgcttgagtgtctgccaagttttgacattaaaggagtgtctttttactgaaaatatttcagagccactggactaaattatccacggttcatcacacatttaacagcttaattcacataccataagatccacccatttgaagtgtacagtgatttttagttgttcacatcttgagtggatacagttcagattcccaaccaatgaatttaattatttgggaaaaagtaaaagatatgtaatggaataagatgagactgtgatgggatttaacccccatttgacaaaccatgagatgtaaaattctgaattgatgccacagataaatgcaccaaccattactaaacataattcagaagcaaatctcaaataactcctcaacaatgagtggactcatacccctttgctgcagaatgccctcatgcgacagaagtctctctagagtttggaaatctttaccaacaaagaaaaattctgatgtattctcttccagttgaacgtcctcagatgacttttggcaggctccagagaatcatcccgaaggtgagtacctctcaaatctaaaggaccagagaacctttttcccttcatggatgtgaacactgataagagtgggagaatatcaaaaatgccctcattgcctctttctccccatgtctatcacaacaacttatgtagcaccgacggcttgataatactaacagttgtgatccttaatacttcttttgttttcatagtgatgccagatactattttaaggagttcacatggattaattaatttaatccataagaagacctctatgatgttgtttcttttattatctccaaatagtaatgagtcacacacttcggttgtcatccatataaaagccatgtgacttggcacaaatcttctaagttattggagctccagattcctagtccatgaagtggaagtaaagaataatagttcatgttatagaccataattatcagcaatataacaataaaatgaggctatcatggtacagagatgttaaagaattttcctggggcgcagtggcagtggtagtctaatccagagcttcaagccatttaaagctcattcacgtttgtatttgtttatgaagttcagatgttgctcactagggcttcaccccatagggcctgatggtgcttccattgagacacccactctctcaacaggaaggaccagctggcctctcttctgttaccggggccactcccatggcttaggaatcgctttgactgttggcccctccttgagctccttaagggttttgtctgcacctggggcatccgagaagccccagtcccagcccaggggatccctcagaggcccctgaatgagtgattctggaagtgcagattcagctctggtttagaaggtaaagggatctgggagttgggttgccagtatggagaacgaattcaaagaaggatccagaaaggtattcattgttattattattacatttgaacaacgtttacaagctcagagaggactttcccttagtctattttacatgtattattcactatttcataagtgaggaagttgagtaaaaagtagtttaagggccgggcgcggtggctcatgactgtaatcccagcaatttaggaggtcaaggcgggcagatcacgaggtcaagagatcgagaccgtcctggccaacatggtgaaacctcgtctctactaaaaatacaaaatttagtggggcctggtagcacctgcctgtagtcccagctacttgggaggctgaggcaggggaatcacttgaaccggggaggaggggaggaggagattgcagtgagccgatatcgcgccactgcactctagcctggtgacagagcgagactttgtcaaaaaaaaaaaaaagtagcttaatattgttggtcagtgacatatctcaatgcaaccagaattggtatgggcaccacctcactgaattccacattcaatgttggtgcctcggtagggtggtatgccatatctgttactgctttctttgctgcctagataaatttcagcaaaccatttctttccctctcccttccctgtattcatctccccacaccatctttcccagcagtgttttgtcccctctctatgtttttacatttactctctgagcagctgtctacaagcttatatgggatcccttgtattttatagaagttcttccttttttagacgttgtgaattcttagaatgctgtttttctccaaatcttctgtgtaccgcactctcaatcacatggagatttctgctgtttgcacgaatgtcagtcttaaaaaagtgtgaagataagcattctaatcctggaaaccccattcatttaggccattccttttgcttctaatctcccaggtttctcttatttaggcaagtgtaactctcccagcattgttgagaacattgattaaggtaatgcatgtgaagatgctttgtaagctctaaagcactatagaaatgtcactgattctgtttatctgtgaccttcacattataaagatcatgcccaagaagccagcagaggaaggaaatgattcgaagggagtgtcagaagcatctggcccacagaacgatgggaaacagctgcgccgccccgggaaaagcaaatacttctgagaagattaataagagatctggtaagaggaatcaatttgggaacaactcctctggcttttctggctatgttcaggtgtgtggactgggtgtgtggcatggatcccagacaagtctgggtccaggctgggctgaggagctcgcccagctccagatgagatgttagacatgacttccagagacacagactggagttgtcacccatataaaaaaccacgtgacttggggcaagtctttcaaattttctcagctccagactcctagtccataagatggaaataaagaatcatagttcataaattgtttggagacattaaatttaatctagaaggcctgatgacatgaaaggtgctcaagcgattctatcagtgataacctgggatcatatcttactcagctcaatgcctgatacccaatgcaggtgtacttcagagatattgcagattcggttccagaccactgcaataaagtgagtcacacacattgtttttcgattgttttgcagtgcataaaaacattatgtttacactatagtgtactctactaagtgtgcaatagcattatgtctaaaaatgtacataccttaattttaaaataattcattgttaaaaaatgctaacaatcttctgagccttcagtgagtcacactcttcttgttggtgtggggtcttgcctcagtgttgatggctgctggctgatcaaggtggtggttgctgaagggtgaagtggctgtggcagttccttaaaagaacacaacagtgaaatttgccacatggattagctctccctttcatgaaagatttctctgtagtatgtgatgctattcgatagcatttagccactttagaacttctttcaaagttgaagtgaatcctctctagctgtgaaagttttagatgacatctacttccaataaaaggctattttatctttattgaaaatctgttgtttagtgtagccaccttcatcagtgatcttagctagatcttctggataacttgctgcagcttctccaacagggtttgctgctacaccttgcacttttatgttatgaagatgacttccttccttaaacctcatgagccaacctctgctagcttcacacgtttcttctgcagtttcctcacctctctcagctttcatggacttgaagagagttcgggtcttgctctgaattagactttggcttaaaggaatgttgtggctggtttcatgttctatcctgatcactcaaactttctctatttcaacagtaagactgttttgctttcttattcgtgtgttcactgggtattagtattattatttccttgaagaacttttcctttgcattatatactattctttccttcaagaacttttctttgcatgcacagcttggctatttggtgcaagaggcctagctttcagcctatcttggctttcagcatgccctcctcactaagcttagccatttctagattctgatttagtgtgagagaatgcaagtcttcctttcatttgaactgttagcggccattgtaggattgctaattgtcctaatttcagtattgctgtgtctcagggaataggtaggcccaagaaaaggaaaagagtcgggaagcgctcatcggtggagcagtcagaacacacacaacattgatcaattacgttcgtcatcttctctgggtggagttcctgttacgcccaaaacatttacaaacaacagggtgactatagtcaataataccttagtcatacatttaaaaataactaaaagagtgtaattggattgtttgtaacacaaggataaatgcttgaccggatggataccctattttccatgatgtgattattacgcattgcatacatgtatcaaaacatctcacataccccataagtatgtacacctactgtatatccacaaaaataaaaaaaattattttaaagactaaaaaacaacaaaaacaattgcaataataacatcaaagctcactgatcacagatcaccataacagatacactaataacagaaaagtgtaacattggtgagaattcccctcaaaaaattacagtatctgcaaagcactataaaaatgaggtgccataaaacaaggtatgcctctgtgcccttaacaaatatgtgcagcatgaaaggaggtatgggtgaatgttcctgtaaatgaagacgttgggaatctaaacctgacaacggaaggagccagaagctaaaactttaattggtatttgtcgtgtattggtgtggatctaaggtctcagcctctttaagccagagaatgtgaaaaactggataaagaaggcccatgggcacttgggaggggggaggcatctcctttttttgagaaaacagagcctaacattcttcaacctacccagtcctcatcttccaactcttcttcatcataggacccaaaagggggagacatgcctggacccacagactgcgtgagagaaaccagctggtgatttatgaagagatcagagaccctgaggaagatgatgagtaactccgtaagtgaacctttggctcatcccccacatccctgcagatgtgctattctgttatggtactggtatcccatcttgtcatttgtttcccaaatcattcctttctcataattttctagtgtacagcattgaggctgaatgatgagatttcccatgctctttctactccctgccctgtatatccagggatcctccctacccaggatgctgtggcttcccaaaccccaggtcagccctgatatgtggccacaccttcctctagcctaggaatggataacccaggcgaggaagtcactgtggcatgagcagatggttcacttcgaggaaccatggaaggcgtgtccaggtcctgaggtagggcagaatcagagtgtgcagggtctgcaggtctggagaagttgagattgagttattgggcagtgggaactcgctgtcacttactttccttctctcttctcgcctcagcctgggggatatgacacatgcccatgatgagaagcagaacatggtgacctttcacgaacatgggcatggctgcggaccctcgtcatcaggtgcatagcaagtgaaagcaagtgttcacaacagtgaaaagttgagcgtcatttttcttagtgtgccaagagttcgatgttagtgtttccattgtattttcttacactgtgccattctgttagatactatccttttcaatgatgagcaagacatacttaatgcatatttcggtttgtgtatccatgcacctacgtcagaaaacaagtattgtcatgtattctctgcatagaacagcactatcctcatctctccccagatgtgactactgagggcagtcctgagtgtttaatttcagacttcttcctctgcatttacacaccacacaacacacacacacacacacacacaccaagtaccattataagcatctcccatctgcttttcccattgccgtgcatcctggtcaagcccccctcactctgtttcctgttcagcatgtactcccctcatccgattcccctctatcagtcactgacagttaacaaacctttgcaaacattccccagttgtttgttcctctcattattgtacacacagctctgtgcacatgtgtgaatatttctttagaaagattcttagaagtggaattgatgtgtcaaaggagtcatttattcaacaaaaccctaatgagtgtgtcctcgggctgagcgctattctaggtgctggagagacatcagggaacagggcagacagatgtttctgaccaccattctagaggaggatgtttccagttgttcgttttcttgatttgtttgtttgtttcttctagagatggggtcttgctctgtccaggctggagtgcagtggcatgattatagttcaatgcagccttgaacacctgggctcaagcaatcctcccaccttggcctcctgaagtactaggattacaggcatgagccaccgcacctggcctccagtttttattttgatagagactatacacttcagtcctggagcaggattctgtagcaggtggttgggcaatttggccttcgctctctgaacaattttcgggttctagggctgtgatggtccatttgggagtatgtgggaggagacacagatgaaatcgtcatctggggaacgtggaggaatgaggaagatgcatgcactgtagaccctgtgatggccagggaatagaagagtccacttagtctccatgcaggggatcagcagtgggaaagtcccctggacagaagcatgagactgcccatcaagggtctcaccaaccaaggtcctgggggctggggtggagatgatgatttgggaatgggacagttctttctcacaggtaccattgcaaggtgcagagaggaaacagttgtggggaagggaagggcagaggggagtctattttagaacgaaccattgtgtgtcaatggagacattaaggttccatttacacacagcggacttgaaacaccagccccaggtggaggcaggattggagctgttttgaccatccgtaacccatcaccttggcctcctggttctccccagccttagaaggaggacactatcatcattatgcctatgtaatagatgagagacagagtcccagagagatggtaggtgtcttgtcacaggtcctacagctggcaggtgcaggaggggctgagtttggagttcactgactctagaaacattaaggaggacaagcgtgtgtggtggagggagggagaagtgaacaagccccgggttctgtccccagtcacaaggtagatattgtgggttcatttacccaagacaaggagccctaggacagagagagtgcggggagggagaggcaatcacggatatagtggggacagtgggagacagagatattcagggtgggcagaagaggggcaggcaaagaagcaggggatacccaagaccaagtgtgggctgtcacagccaccagagggagaggatgccaggaaggaggttgtggggctccaggagcaacagaggttccccagatctctgagcatgccctgcctggcactgcaggaagaggtggctgccacccaggtcagtgtggacgtgcctctacctgtgtctcagaggaaacacattctgttttatcccaatatcattctgtattacacaaatgtaacattcagctactagatattgggtgccttatcctccatgcaagtagaggagaggataccctaaaagagatactaaaggatttgatttttctttctccctgggatgatgggatccgtaagttgggtcccccagcccacaagacaggtgcaaggaagggtggctggaagattgtgagtcatgacagggaacatttttcgttaggttccatgggtatataaagctcccgactatctgtctatcatgaatagataaagagtgaacatggtcccctctccacaaatgtgtttctctccttcattattacagtgaaggtctgaagttccgtcaagttctgatacattacttttttttttttttttgagacagagtctcactctgtcatccaggctggagtgcagtggcgagatgtcggctcactgcaacctctgcctgccagggtcaagcgattctcctgcctcagtctccagagtcgctgggaacacaggcgcgtgccaccattcccagctaattttttgtatttttagtagaaacaggctttcactgtgccagccaggttgatcttctgacctcgtgatgtgatggcctcagcatcccaaagtgctgggattacatgcgtgaggtaccgcgcccagtgatgcattacttttttttaaattttttttgagacagaatcgcagtctgttgctgaggctggagtgcagtgatgcaagtacagctcactgcagcctcaatctcccaggctcaagggattctcccacttcagcttacgaactacctgggactacaggcacatgccaccacacccagctaatttttgtattttctgtagagacaggatcccactatgttgcccagtctggtctcaacttcctggccgcaggcaatcctcctgcctcagcctcccaaagtgctgagatgacaagtgtgagccacctcaccaggccttcactttcttcaatgaacaattatcagagtttcatcttagaggcaaaagtgactattgccagccaatctgagtgtggtgttggaggggaatctggctgattcagacatttcaaatgaacttttaaattaacctacctgatgattatcctaaggccctttcttgctccatgtttttttgattctgggtttggagtttttcagaagctttcctacaaagagcatctcctggtcgggcacagtgactcatgctctagtgccagcactttgggaggccaagacaggcagatcacttgaggtcaggagtttgagaccagcctggcctacattgcaaaaactctgcctctactaaaaatacaaaaattagccagctgtggtggtgggcactggtgacttccagttcttgcgggggctgaggcacgagaatcacttggacccgggagacacaccgtgcagtgagccgagatcacgccactgcactccagcgtgggcgacagagtaagtctctgtctcaaaaaacaaacagcatctctcgcctacactcatttgagctgtggtcttgtctcctcgggtttctctgtcagtctgatcccatctactctatctaccaggaatgcctcaatatttctggtggaccactgacacgtcttcctattttcctctactgtcaaggattgactcttgaaaacattttcttcctactttgatggaatgttgagtggggcacgggatctagctgccatcttgttccaatcacctgttattagatatttcatgtatttttgtcacaatataagtgtaatttttctcaatttggttttctaaatggctattattagcatgtagaaaccctatctattattgttaataatattttgttacctgtctgggtacagcttcccatgcattttggcacaagactcaatctattttattcttcaaaacaaaactgacaggctgagtgtggtggctcacacctgtaatcccagcacgtagggaggccgaggcatgtggatcaactgaggtcaggatttcgagaccagcctggccaagacggtaaaaccccatctctactaaaaatacaaaaaaaaaaaaaaaagaaagaaagaaaaattagccgggcattggtggtgcacgcctgtagtcccagctactagggcagctgaggcgggaggatcatttgaactcgggaggcggagatcgcagtgagccaaggtggcaccactgcactccagcctcgtggacagaaactctatctctaaataaaaagaaaaagaataaaagaaaattcacttcaccggcaatagatagttataaaaggataatttatggaagatttcataggggagactgatggaaagaaaggaagtatacattttacagagctgagcagaactcactgcaaaaatcaccagaactgcctttttctccaaaagtgctacccataagctattctactactggttcttctagtccttttctctattccaaatcctcaaattgtccatttccttattggggtaattttcctctgcccagatctgggtcccccaccacacttaacactgtctgtgagggtgtgaattcccattattttagctcaggttcccaaggaaacaggctttgggccatacaggacacatctagacagactatactgagaagccatgcttggaacggtgcatggggagaggagagggaatttatgtacctggctctcactcatggttttttttttttttaattggtcaaaatttaccacataggcatgaactcccccacacttctagattgcatcatctgcccctttcacagctatctgggaagccagatcccacactttgaagtgtagtgtttcatacaatccaaaagtggtcatagaggccaggtgttgtggcttacgcctgcaatcccatcactttgggatgccaaggcaggcagatcatgaggtcaggagtttgagtctagcctggcaagcatggtgaaacccagtctgtactaaaaatacaaaaattagcccggcatggtggcacacacctgtaatctcagctactcgggaggctgaggcaggagaatcgcttgaccctgggaggcagaggttgcagtgagctgagattgcaccacggcacttcagcctgggcgacagagcaagactccatctgaaaaacaaaacaaaacaaaacaaacaatcaaaaaagtggtagcagaaaccagaaagtccacgtaggtagctaattgctttggttgtatagcagcagccaagggtgaaaactaaatactcccaggcaagtcctgagttcaccaaggaattggagtacccatctgtgctagttaattgcctttatctgaaggaaaaataaaactcgtatctctatgacaagcaggtgcttacagcttggagcaaggcacctaggcaaactcccctggtgacagggagactgggacgtcatcttcctccatgttcacatttcaaagagatggctcaaggccctgaagaaagacctttctagggactggacatggtggctcacacctgtaatcccaacactttgggaggctgaggctggaggatcacttgaggcctggagttcaagtccaagacattcccgggatatacagggccagaggcttacatatcaaagaaagaatttaccaacacaaattttctgaaggaaatgctctagggaaaggaaaatgggaaaaggtatcttcttcccttttggcaacaggaaaatctaaattttatgtgtagttaaccttacaatttcccccttttgttattttatagaaacattacaattttctaattatctccactgctgtttctatctttctctgggtagcgtacagccacatagatatccaacaagtccatagtaagatgcaaagcaaagcaattatcagaattataatagaatgactttttttttcgggacagagtttcgctctcgttgcccagactggagtgcaatggtgcgatcttggctcactgcaacctctgtctcctgagttcaagggattttccttcctcagcctcccaagtagctgggattacaggcgtgtaccatcatgcccaactaatttctgtatttttagtagagacagggtttcatcatgctggccggatggtctccaactcctgacctcatgatctgcctgccttggcctcccacagtgctgggattacaggcgtgagccaccacgcctggcctctgctaacacttttggattgtatgaaacactacacttcaaagtgtgggatctggcttcctagacagctgtcaaaggggcagttgatgcaatctagaagtgtaggggagtttgcacctgtggggtaaattttgaccaataagaaaaggaaccaggagtgagagtcaggtacgtaattccctctcctctcctctcctctccccatgcaccattccaggcattgtttctcagtatagtctgtctagaggtgtcctgtatggcccaaagcctgtttccttgggaatctgagctaaagcaatgggcattcaaacactcgaagacagtgttaagtgttgtggaggacccagatctgggcagaggaaaattatcccaataagaaaatggacaatttgaggatgtggaatagagggaaggactagaagaaccagtagtagtatagcttaggggtactatttttggagaaaaaggcagttctggtgattgttccagtgaattgctcagctctgttttatatatataaatatacataaaggatatatatatataaatatatatgtgtgtgtatatatatgtgtgtatatatatgtgtatatatatgtgtgtatatatatgtgtatatatatgtgtgtgtgtgtgtgtgtatatatatatatatatatatacatcattctttccatcattctcccctatgaaatcgtccataaagtatccttttataactacctattgcctgggaagtgaattttctttatcttttttctttagagatagagtctctgtcgcctgggctggagtgctgtggcacgatctcgactcactgcaatctccacctcccgagctcaaatgatcctcccacctcagctgccctagtagctgggactacaggtgcgcaccaccaatgccaggctaattttttaattttattgtatttttagtacagaagggggttcaccagcttggccaggctggtctcgaactcaattgatccaccagcatcagtctcccaaagtgctgggataagaggcgtgagccaccgcacccagcctgtcactttctttttggagaataaaacatattgagtcttgtgccaaaatgcaggggaagctgcacccagaaaggtaacaaaatattatatatatagatagataggttttctacataccaatattaaccatttagaaaaccaaattgagaaaaaatacacttatatagtgacaaatatacataaaatatctaaaaccagatgattggagcaagatggcagatagatcccatgccccactcaacattccattgaactgggaagaaaatgttttcaagggtcaattctcaagagtagaggaaaataagaaaacgtgtcagtggtccaccagaaatattaaggcattcctgggagatagagtagatgggatcagactgatagagaaacccaaggagacaagaccacaggtcaaatcactgtaggcgagagatgctgtttgagacagagacttactccatcgcccaggctggagtgcagtggcgtgatctcggctcactgcacactctatctcccaggttcaagggattctcctgcttcactccccactgtaactggaattcatagaggcctgccaccatggccagctgatttttgtacttttagtagagatggaggtttcaccctgttggccaggctagtctcaaactcatgacctcaactgatctgcctgcctcggcctcccaaagtgctgatattacccagcgtgggacgccgcccaggtgatgatctttgtaacaaagcctctgaaaaactccaaaccctgaatcaaaaaaacacagagccggaaagggccttaggataatcatcaggtaggttaatttaaaagttcattagaaacatctgaatcagccagattcccctccaacaccacactcagattggctggcagtagccacttttgcctctaagatgaaactctgataattgttcattaaagaaagtgaaggcctggcgaggtggctcacacttgtcatcccagcactttgggaggctgaggcaggaggattgcctgaggccaggggatccagaccagcctgggcaacaaagtggatgccgtctctacaaaaaaaatacaaaaactagctgggtgtggtggcgtgtgcctgtagttccagctagattggaagctgaagtgcgagaatcccttgagcctgggagatcgaggctgcagtgagctgtacttgcatcactgcactccagcctggtccacagagtgcgatcatgtcaaaaaaaaacacacacacacacacacacacacacacaaaagtaacatatcagaacttggtgtaacttcagcccttcacaaggagagaaacacatttgtggagaagggaccatgttcactctttatctatccatgatagacagatagtccggagctttatatacccatggaacctatggaaaaatgttgcctgtcataactcacaatcttccagccacccttccttgtatctgtcttgtgggctgggggaaccaacttatggatcccatcatcccagggagaaagaaaaatcaaatccttcattatctcttttggggtatgctctcctctatttgcatggaggttaaggcactcaatatctagtagccgaatgttacatttgtgtaatacagaactatattggtataaaatcgaatttgtttcctctgagacacaggtagaggtacgtccacactgacctgggtggcagccatctcttcctgcagtgccaggcagggcatgctcacagatctggggaacctcttgctccttgagccccacaacctccttcctggcaccctctccctctggtggctgtgacagcccacacttggccttgggtctcccctgcttctttgcctgcccctcttctgcccaccctgcatatctctgtctcccactgtccctgctgtgaccacgactgcctctccctccccgcactctctctctcctagggctccttgtcttcggtaaatgaacccacagcctttacattgtgactggggacagagcccggggcttgttcagttctccctccttccatcacacacctgtcctccttaatgtttctgaagtcagtgagatccaaactcagcccctcctgcacctgccagctgtaggacctgtgacaagacgcctgccatctgtctgggtctccgtctctcatctgtcacataggcataatgatgatagtgtcctccttctcaggctggagagaaccaggaggccaaggtgatgggccacgaacgggcaaaacagctccaatcctgcctccacctggggctggtgtttcaagtccattgtgtgtgaatggagctttgatgtctccattgacacagaatagtttgttctaaaatagactcccctctgcccttccttccccacaactctttcacctctgcactgtgcagtggtatatgtgagaaagaacagtcccattcccaaatcatcatccccaccccaactcccaggcccttgattggtgagacccttgatgggcgttctcatgcttctgtccaggggactttcccaccaattgctcccctgcatggagactaagtggactcttctattccctgtccatcacaggatctacagtgcacgcatctgcctgattcctccacattccccagatgacgatttcatctgtgtctcctcccacatccacccaaatggaccgtcccagaccttgaaaccgaaaatcattcagagagcgaaggccaagatgcccaaccacctgctgcagaatcctgctccaggactgaagtgtatagtgtatatcaaaataaaaactggaggccaggtgctggggctcacacctgtaatcccaacactttaggagaccaaggtgggaggatcgctttggcacaggaatttaagaacagcctgggtaacatagacagactttcttgacaaaatcttaaaaaaattagtgggtcatgatggtgcatgcctgtagtcacagcttctctgcaggctaaggtgggaggatcacttgagcccacgagttcaaggctgcattgaactatgatcatgccactgcactctagcctgggcagtgcaagaccccttctctagaaaaaagaaacaaacaaagaaacccaacaactggaaacatcctcctctggaatggtggtcaggaacatctgcctgccttgttcactgatgtctctccagcacctagaacaacgcccagcacgagaacacactcattagtgttttgttgaataaatgactcctttgacacagcaattcaacttctaagaatctttcctaaagaaatattcacacaggtgcagagacctgtgcgcacattaatgagaggagcaaacaactggggaacgtttgcaaaggtgtattaactgtcagtgactgatacggggaatcagaggaggggagtacatgctgaacaggaaacaaattgaaggggggcttgaccaggactcatggcaatggggaaaagcatatgggagatgcttatactggtacttggtgtgtctgtgtgtgtgtgtgtctgtgtgtgtgtgtttgtgtgtctggtgtgtaaatgcagaggggaaaatcggaaattaaacactcagatctgccctcagtagtcacatctggggagagaggagggtagtgctgttctatggagagaatacctgactatacttgctttctgaggtaggtgcatggatacacaaaccgaaatacacattaagcatgtcttgctcatcaatgaaaacgctaatatctaacagaatggcacactgtaagaaaatacaatggaaacactaacatcgaactcttgtcacactaagaaaaacgacgctcaacttttcactgttgtgaacacttgctttcacttgctatgcacctgatgacgaggggtccgcagccatgcccatgttcgtgaaaggtcaccacgttctgcttctcatcatgggcatatgtcgtatccccgaggctgaggcaagaagagagaaggaaagtaagtggcagtgagttcccaccacgtgacaactcaatctcaactcctcctgacctgcagaccctgcacactctgattctgccctaccccaggacctgcacacgccttccatggttccttgaagtgaaccatccgctcatgccacagtgacttcttcgcctgggttatccattcctaggctagaggaaggtgtggcccacatacagggctgatctggagttcgggaacccacagcatcctgggtagggagcattcctggatatacagggcagggagtaaaaagagcttacgaaggccaggcgcggtggttcacgcctgtaatcccagaactttgggaggccgaggcgggcggatcacgaggtcaggagaccgagaccatcctggctaacacggtgaaaccccgtctctaccaaaaatacaaaaaaaattacccgggcgtggtggcgggcacttgtagtcccagctactggagaggctgaggcaggagaatggcgtgaacccgtgaggcggagcttgcagtaagcggagatcatgctgctgcactgcagcctgggccacaaagggcgaatccgtcaaaaaaaaaaaaaaaacgtgggaaatctctcatcattcggcctcaatgctgtaccctagaaaattatgagacgggaatgatttggggagcaagtgacagatgggataccagtatcataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctccttctgttgtggggtttagattcccaaccttttcacttacgggaacatccacccttacctcctttcattcagcacgtgtttttattgagggcaccgaggcatacttttttttattgcacaacattttcatagtgcttcacagatgctgcaatgtttttttttggaaactctcatcaattttacacctttccgttattattatatctgttatagtgatctgtgatcagtgagctttgatattattactgaaattgtttttgttgttttttagtcttttaaaataattttaattttttaatttttaatttttattttattttattttgtttgagatgaagtctcgctctgtcgcccagactggagtgcagtggagcaatctcagctcactgcaacctctgcctctccagttcaagcgattctcctgcctcagcctcccgagtagctgggactacaggagcatgtcaccacgcctggctaatattttgtatttttagtagagacggggtttcaccgtattagccaggatggtctcgatctcccgacttcgtgatctgcctgcctcggcctcccaaagtgctgggatcacaggcgtgagccacggcgcccgtccgtgttttttatttttgtgcatacacagtaggtgtatatacttatggggtacgtgagatgttttgatacacgcatgccatgcgtaataatcacatcatggaaaatagggtatccatcccttcaaccacttatccttgtgttataaacaatccaattacactcttctagtttttttaaaatgtacaattaagttattattgacaataatcaccctgttctgtgtaattgtttggggggtgggtaccaggaactgcacccatagaagatgacaaacttaatcgattaatgttgtgtgtcttctgactgctccaccgatgagctattccccatctctcctccttttcttggacctccctatttcttgagacacacctatattgaaattaggatgattgacaaccctataatggccgctaagtattcaaatgaaaggaagagtcgcgtgtctcacactgtacatcagaagctagaaatggctaagcttagtgaggaaggcatgctgaaagccaagacaggctgaaagctcggcctcttgcaccaaacagccaagctgtgaatgcaaaggaaaagttcttgaaggaaataatagtatataatgcaaagggaaagtccttgaaggaaataataatattaacactccagtgaacacacgaataagaaagcaaaactgccttactgctcaaatagagaaagtttgagtggtcaggatatttgatgaaaccagccacaacattcccttaagccaaagtctaattcagagcaagaccagaactctcttccagtccatgaaagctgagagaggtgaagaagctgcaggagaaatgtgtgaagctagcagaggttggttcatgaagtttaaggaaagaagccatctccataacttaaaagtgcaaggtgaagcagcaaaccctgatggagaagctgcagcaagttatccagaagatctagctaagatcactgttgaaggtggctacactaaacaacagattttcaatgtagataaaatagccttctattggaaggagatgccttctaggactttcatagctagagagaattgactcgaactttgaaagaagttctactgtgggtaaaatgctgtccatagcatcacatactacagagaaatccttcatgaagcagagagttaatcaatgtggcaaatttcattgttgtgttcttttaagaaactgccacagccactccacccttcagcaaccaccaccttgatcagccagcagccatcaacaccgaggcaagaccctccaccagcaaaaagagtgagtcactgaagactcagaagattattagcatttttgacaatgaattattttaaaataaaggtatgtacatttttagacataatgctattgcactcttagtagactgcagtatagtgtaaacataatgtttttatgcactgctaaaccaaaaaaacaatgtgtgtgactcacattattgcagtggtctggaaccgaatctgcaatatctctgaagtacaactttattgggtatcaggcattgagctgagtaagatattatcccaggttatcaaagatagaatcgcttgagcacctttcatgtcatcaggccttctagattaaatttaatgtctccaaacaatttatgaactatgattctttatttccatcttatggactaggaatctggaactgagaaaatttggaagactagccccaagtcacgtggtttgtatatgggtgacaactccagtctgtatctctggaagtccagtcaaacatctcatctggagctgggcgagctcctcagcccagcctggacccaggcttgtctggggtccatgccacacacccagtccacacacctgaacatagccacggaagccagagggtttgttcccgaattctttcctcttaccggatgtcttgttaatcttctcagaggtacttggttttcctggagggcacaggtgtttcccatcgttctgtgagccagatgcttctggcactcccttcgaatcatttccttcctctgctggcttcttgggcatgatctttataatgtgaaggtcacagataaacagaatcagtgacatttctatagtgctttagagcttacaaagcgtcttcacatgcattaccttaatcaatgttctcaacaatgctgggagagttacacatgcctaaattaggagaaacctgggaagttagacgggaaaggaatggcctatgtgaatatcgtttccagggctagaatgcttatcttcacactctttaagactgacattcttgcaaacagtaaaaatctccatgcaattgagagtttggtatacaaaagattggaagaaggatagcatttttaaaattcacaaggtctacaaaaggaagagcttctatgaaatacaagggatctcatataagctcttagctgctgggagagtaaatgtaaaaacatagagaggggacaaaacactgctgggaaagatggtgtggggagattaatacagggaagggagaggtaaagaaatggtttgctaaaattaatctaggcagcgaagaaagcagtaccagatctggcataccaccctaccgaggcaccaacactgaatgtggaattcagtgaggtggtacccataccaattctggttgcattgggatgtgtcactgaccaacaatcttaagctacttttttttttgttgttttgttttgagacagagtctcactctgtcaccaggctgcagtgcagtggcacgatctcagctcactgcaacatccaactcctgtgtttaagtgactcatgcaacagcctccagagtatctgggactgcaggcaggcgctaccacgccccgctaagttttgtatttttaatagagatgaggttttaccatgttgggcaggatggtcttgacctcttgacctagtgatccatccacctcagcctcccaaagtgctgggattacagtcgctagccaccgtgccccgctcttaatctactttttattcagcttccttgcttatgagatagtgaacaatacatgtaaaatagtctacgggaaagtcctctctgagcttgtaaacactgtttaaatgcagtaataataacaattaatacctttcatgatccttccttcaattcggtctccacactagcaacccaactcccagatccctttaccctctaaaccagagttgaatctgcacttgtggggtcactcattcaggggcctccgagggatcccctgggctgggatgggggcttctgggatgccccaggtgcagacaaggtcctcaaggagctcacagtagggaggggccaacagtcaaaacgattcctaagccatgcaagtggtcccagtaacagagcagaggccagctggtctttcctattgcgagaatgggtgtctcaatggaagcaccagcaggccctatggggtgaagccctagtgagcaacatctgaacttcataaacaaatgcaaacgtgaatgagctttaaatggcttggagctctggattagactaccactgccactgtgccccaggaaaattatttaacatatctataccccaatagcctcattttattattatgttgctgataactacgattctttacttccatttcatggaccaggaatctggagctcagagaacttagaagacttgtgccaagtcacatggcttttatatggacgacaaccgaagtgtgtgactcattattatttggagataataatagaaacaaagtcatacaggtcttcttaaggattaaatacattaatccatgtgaactgcttaaaatagtatctggcatcactatgaaaacaaaagatgtattaaggatcacaactgttagtattattaagctgttggtgctacatcaggtgttgtgatagacatggggagaaggaggcagtgagggcattttttatattctcccactcttaccagtgtttgcatccatggagggacaaaggttctctggtcctttagatctgagagacactcaccttcgggaagattctctggagcctgcaaaaagtcatctgaggacgttcaactgaaagagaatatatcagaatttttctttgttggtaaagatttccaaactctagagacttctgtagcatcagggtattctgcagcagagtgttatgagtccactcattgttgaggagttatttcagttttgcttctgaattatgtttagtcatggttgattcatttatctgtggcatcaattcagaattttccatctcatggtttatcaaatggggactaaaccccatcacagtctcatcttattcctttacatatcttttatttttttccaaataattaaattgattggttaggaatctgaactgtatccactcaagatgtgcaacaactgaaaatcattgcacacttcaaatgggtgaatcttatggtatgtgaattaagctgttaaatgtgtgatgaaccatggatgatttagtccagtggctctgagatattttcagtataaagacagtcctttaatgtcaaaatcttggcagacacccaagcactggattttcagatctcttacagtgatcgtgggagattttagaatctggcctttttagttggggagtaataggtctattggagacagtttggacgttctgaccttgtcttataattgtgttgtcagagcagaagagcaaggaaacacatatgtgacccctttatattcccaaaacgtacaaagatctctaccgaagaacctgtctttttttcaccctatgttatctctgctctctggcaagtgggaaagctctctctgtgtgttggatgagggatcactctttcaaactctcttccaagctcatcacggagaatcagggttctttgggaatgaaaagactatttggctctgataaaatacagagaaacagcgatctttattacataatgtgttcatcatcctcactcctaagatacctatccaatacctacatgctgttaatgagacaaactctggaagtttttggcgaatctacagttgtaacattttctttcttctttttttctcttgtaacatttttttagcagtcctttgattcattaatggtgcttaggaagaacaacatgtcatctaaaaaagaaatatttcaaacacacagaaaagtatgaggaataatattgagtccagtcggatctcaacattaccccacagctatgctaggtttgatttatttattcacaatattagaaaaactacaaacaggccgggcatggtagctcacacttgtaatcccagcactttgggaggctgaggcaggtggatcacctgaggtcaggaagtttgagaccagcctggtcaacatggtaaaaccccgtctctaccaaaaataaaaaatgagctgggtgtgggggcgggcacccgtaaccccagctactccggaggctgaggcaggagaatcacttgaacccaggaggtgaaagttggagtgagctgagattgccttattgcactctaccctggccgagaagagtgaaactccatctcaaaaacaaaaacaaacaaaacacactatcaacaagtcacagctgaagctgtctgtgcagcactcagcaatccctgcccgccctccctcctccacttacagccagtcacctcaatttgatggctttttattcacattcatgtttgtatacatttaccatttacttattatctataaaaatatatattcttgtttttcgtgttttaaaattttatatgaatggcctctgtagttaactttctgcatgcaatttttttttttttcactcagccctgatgtgtatgagggaacaaatgcctgaggatctttcccaagtagctgagctgaaaagcagctgggcttgaggagaccctttccagccccttcccgtctactcaccctgattcccttggttacggtcattatcaaaatcattcccctggaggtctgtggcccctgtattatgcatgaaaggtgggagggtggccttgaagcctagaaagaagcaaaatgtttattccttaagagacaagctttgacctgtcacggtggctcatatctgtagtaccagtgctttgggaggctgaggctggagtattgcttgaggccaggagttcaaggctgcagtgagctatgactgcactactgcaaactagcctaggtgacagactgagactcagactcaaaaaaaaagaaagaaagaaagatacaagccgagagaaggaaggtagggacggtgtgggggtgccgggatgccacagagacacttggactcatcagaacagaagcctaagggagagaaacgtgcaggatccaggtatgagctccactgtggccagtccctgccctcagccctgacaggatacagaagaggagaacacccagaagctgccttgcgatttttccctgcacaaaaggaaaatgtggggtactttctgcagcctaagaagtagccaaagcaggaatagggatgctcatgtgtccccagacttgtctgtacctagaactttctgttacctagtttagtcatggcctcatactttctcttcatatacacatagctgattttctccaaggatttcatcttttcccactctttcttagagaagtatttggcaatatcatcgaaggactaggaaaagataaaaaaggaattttgtcagtgactcagctagacatgtctgccattcagctggagccccttcctgtgtgctggatctgggaagtggggatgatgccatggctaaccgacaacatgagcgacctttcctagcttcacccctgccacacagtagggctttaatgctgctgactgactctcttcccactttccagaatggactgagattcaccaaatgtagtgcacggtcacagacttgtctccaaggatgctagttgatgacagagcgaggatgggaggctctcaaggatccagatctcccccaagaccctggtccttgtctccagtatctctgtcctcccctcctcagaaacttggccaccccacactgtcccctgggccactactctgctccctccaggtcacctcaccttttggatcttctctggtatttgagcaccagccctaggtctccttgcaaaggcgtcgtctccgttcatggcaccaggagcagtctgacctgcaagagaaatagcctgagtctttccagccacagcagctttggtcttgtggagggagaaatcagtgaaggccggccaccctcagtcacctggaatcaggtgcttcatttctccatctggggcttatctgtccctgagtaatgacatggggcgaagtcagatgaaaatagggaaccaggggtctctgggagaagtattgatttgggatgacaggcttcctgtgggcaaagcagccttgagtctttgggagggggttggctaatgttgttagtagtttccctggggctagccttactctgaaagatgtacagacccttgttgggaaggcagagatgtgactgtgtaattttattcagtgggggcatgctgacaccccgactcaataaataatggaagggaaatgagtcccagagataacatcgtctctctggtgatggatctgatcaggcagagggatagggggttctgttctgttgaagagaaatgagcatggctaatatgaacggatttagaggctattactgggtgatttgtaaattattagaagaagagagctagaatttctgagactacaagagcccgccatcacttagagagaatgtagggagtttcaaggtgcagcaatcagccaggcgcagtggctcacgcctgtaatcccagcactttgggaggccaaggagggcggatcgcttgagcccatgagcttgagaccagcctggccaacataccgaaaccatctctactaaaacaacaacaacaacaaaacacacacacacacacacacattaacagaagcggagtggtgtgcacctctagtcccaaggcctacgcgagaggatcacttgatcccaggaggaaagatttgagtgagtttttttttttttttttttttgagtcatggtctctctctgctgcccaggctgggatgcagtggtgtgatcatggctcactgcaacctccgcctcctgggttcaagtgatccaccagctgtggcctccaaaactgctggaattacaagcgtgagccaccgtacccggcccaaatttgttaagttactagagttcccaggaaaaatcccatacctgaaaaagttagaaactgacaggaaggatttgagatggcgacctgcctcacatacactccttattaaaactagataacaaatgcaccacagaggaggggaggggtagtaagaatggaaaaagaaaatcagcgcatgcttactctgattttggaagaatcaaaagagaaaatcagaccgtgcgtactctgagtatggaagaatcgagagagaaagtcagagcatgcatactctgaacttaaagtagccaatcccaggggatgctttaggcgggaaaatcagagtctccacccccactttgagaaggttctgtccctggagcctggactgatagaagccacatcagcttcgcttatcacgctactgttctgacttctgattggccagatggagttcactaactgccctgattggtccatcatccctgcatagtgacattgcacaatattgtctcctcctccagcaacactttgttgccactgcgacaaagtgggtggtcctcaggcgccgtcaggagattttgaactctctgaagaccgtccctggatcttgggttaaaaatctgttttctagtctgaacagcgagaagaaaaaaatagtcggatctgtgatttttctacttgaaagacacaatgttttccagactagcacatttgcagagctttgctgtacttagtagtggctttcattcttcagtggcttctatatctgttgctactgaaaaaacagtccaaggccctccaacctctgattacatttttgaaagggaatctaagtgtggtgtgcacaattaccatcctttacctgtagccctggagagaggaaaatgtatttacttatgggatgtgattgtggtattggttacatccgccttggccaatcttcccgcctcggtctcgcgactacaggtgggaaccaccccacccccactaatattttttgtttttggattttttaaaagagacggtttcgctatgttggccaggctggcctcaacctcctgggctcaagggatccttccaccacggcctcaggactactgccattctgccctgctcatttttattttattttattttattttattttatttatttatttatttatttatttatttatttatttatttacttataggaaagacaggctttcgctacgttggccaggctggtattgacctcctgggctcaagcagtcctcccaccttggcctcggaactacaggagtgagccatcccacccacgcaatttttttgttgttcttgttgttagtagaaatggggtttcgctatgttggccaggctggcctctacctcccgggctcaaacaatcctcccgcctcagcctggtgactacaggctcacaccaccccaccaccactaatatttttaatttttctagcagagacagttttgctatgttgtcctggctggtccctacctcctgggctcaagcgatcctcctgcttcagccttgggactacaggcatgcaccgccctgccttttgctatttttccccggctgcttttgactttctgggctcgctcaatgatttgaacctgggaagcggacgttgcattgagctgagatcacaccactgcactccagcttgggcgacagagcaagactgtcaaataaataaatacatccatacttgaaagaaagaagaaagaaaagaaaggaaggaaggaaggaaggaaggaaggaaggaaggaaggaaggaaggaaggaacgaacgaaccagctgaaactctgtaaaaacagtaagctttgtggtatattaacttaccctcatcccatctcgtgctcccagcttggttctgttcattgctgctgaaatacagataggattggccagaactggtagatggctggctgttgatcatgaaaatgtcagacctgatatagtcctcctcggaaaggccttttctgggggctgatactctatgtctgcagtgctgtgggacgatgacataatgctgagcattaagccaggcgaccatgggtccacatacggtggcaatccactaggctgccgagtggccatcgcagcccttgaggttttagaagaagaaaaccttgctgaaaatacagaaaacaataggtattctcttgagaaatgaacccatgaagctaccttctgatgctgtaactgctgtaagaggaagagaattattgtgtgtatgtgtgtatgtatgtatgtatttagagtcagaggttcactctggttgcccagtatgcaatggtgcgatcttggctcactgcaacctctgcctgctgagttctagcgaatctccttgcctcggcctcctgagtagctgggattacaggcatgtgccactatgcccagctaattttcatatttttagtagagactaggtttcaccatgttggccacgctggtcttgaactcctgacctcaggtgatgcacccacctcggcctccgaaaatgttgggattacaggcgtgagccactgtgcctgggaggaaaagaattattaatttctattgttattaaagaaagcaaagattgtgatgcttggaaggtgtgtctacgacttcaagattatccacttctggccaagccaacccatggcgacatcatcaggtttcgcctccgctggtggtgaagggggatgagattcaagtccagtgaaatcattaacaagaccatcttgtcgttctgagggtagcagctgttttcagtggtccctgggagccggctggagacaggtggtcttgtaaaagctctgctcttaatgcgggcacattccactccatgtgtcttcaaaatctttttgtggagtatctatttttttcagttaatacatagcagaacaacgtttatgaagctgctgtttgctttgtaacgtaagtaagagcatgcaatggcatctatattctgtgaaagtgttttgatgtgtactttctaaggttaaacgtatctacatatacagacagtgtttaaattacatccttcagtatactttatatatgtttttataatttccttgctggtataaatgctttgcatttgaaaaagttatctctagggaattacataaaagacttcaccttataaagtcaaatcattgttatcattgaattttaggaaggatgaatggttaagtatgtataaaatactaatattaagtaaacttcctgttggccaacaccaggatgtattctatggatgtcattattttcaattaagaattagtgtttaacattcctaaattgttttgagtgcttgattataatttgttaaaaaatgtttatttttaatatttctttaaatttagtataaagcttatatttcagaaaaaaaaaagatacagaacatgcctgggtgcagtggttcacgcttgtaatcccagcactttgggagggcgaggtgggcagattacttgagatcaggagttcgagaccagcctggccaacatggagaaaccctgtctctactacaaaaatacaaaaaatacaaaaatacaaaaattagccaggcatggtggcacacgcctgtattcccagctacatgggaggctgagacaagagaatcgcttgaacccgggaggcagaggttgcagtgagccaagatcatgccactgcactacagcttaggtgacagagtgagaatccctctcagaaaaaaaaaaaaaggtacagaacatttccatcatcataatgctatcccttgtgctactcatttttagtaatactcactctcatcccatccaccatccctaacccctggcaaccactaatctgtttttcatttctataattttctcttttctacaatgctgtacaaatgaaatcttatagtatataacgttttaggggtttatttcactcagcataattccatggagattcctccaagatattgatatttgtgtatcaatagttcattgttgttgttgttgttgagacggagtctcactctgtcgcccaggctggagtgcagtgtctcagctcactgcaacctctgccacccaggttcaagcagttttctagcctcagcctcccaggtagctgtgactacaggtgcatgccaccacacctgggtaatttttatattagtaatagagatggggtttcaacatactggcaaggctggtcttgaactcctgacgtcatgatccacccgcctcggcctcccaaagtgctagggtaacagggtgagccactgtgccctgacgatagttcatttttattgctgagtagcattccaggggatggatataccacagtttgaccattcacttattttaggacatattgattatttccagctattggctattacaagtaaagctgctatgaacaattatgtacaagtttctggatgggcatacattttaatttctctgaagtgtaattgttgaattgtatggtcactgcattgtttagttttataagaaactaccaaactgctttccagagtggctgtaagattttaccttcccagcagcacttaatgaggtgtccagtttctctgcatccttgtcaccatgttgtcactatgtcttttattttagctattgtaataagtgtgtagtgatacctcatcgtggtgttattctgcatctagtgaagcaaatgagtgttgaacatcttttcatgtgcttatttgcttatttcctcttcagtgaaatgtatgttcatatcttttcatgattttctaattggattatttgtttgcattttttaccattgaggtttcttttattattattatttttcttgagacagagtctctctctgttacccaggctggagtgcagtggcatgatcttggctcactccaacctccgccttccaggttcaagcgattctcgtgccttagcctcccgagtagctgggattacaggcacgcatcatcatgcctgtctaatttgtgtatttcagcagagatgtgttttttgccatgttgcccaggctggtctcgaactcctagcctcaagggatctgcccccgcccccccgacctcgacctttctaagtgctgggattacaagtgtgagccaccatgctcagcctaccattgagttttgagagtagtatgtatatccattatatattctggatgtgagtcctttcttggatatgtggtttgcaagcactctctcccaggtcataacctgttttttcatccttttaaaaagatttcttgcagagcacaagttttaaattggatgaaatctaatttatttttttccttatggattatgctttttgaaccgttcactatgccctagatctcagatgtttctcctatattttattgtaaaagttttcttttagttttatattttagatttaaatctatgatccacttgagttactttcttgtataaaggtatgaaaattaggtcttttttttttggcctatgtctacaacatcttcagcaccatttgttcagcagacaatccttccttctttttgtctcttggtaaaaaatcagtgtggggctatttctaggttctctattttgttccagtgatctatgcgtctattcttctcccagtactacacagtcttgattcctatagctatataaaaagtattgaaatatgaaagagccattcctcccaccttattcttctttttcaaaaattgtcttagctatataaatattttttgagatggagtctcacttgtgtcacccaagctggagatcagtggagtgatcttggctcgctgcagcctccacctcccatgttcaagtgattctcctgcctcagccccccgagtagctgggatttcaggcactcaccaccacacccagttaatttttgtatttttattagagacggtgttttgtcatgttggccaggctggtcttgaactcctgacctgaagcgatctgcccatctcggccttccaaagtgctggtattacaggcgtgagccaccactcccagcgttgtcttagctattgacaatttgttacagcaacaatcaaaaatgaatatacgtagaaacagattagtgtaactaaatagaaagtcaagaaacagactaatttatataccaacttcagcatgcatttccaaacaaacagtgggcaaaagatgggttgtataataaaggattggtgacaagtgtctatccatttgaaaaaatgaagattaaatccttactctgaaccacataaaataataaattctaaatgttcagagacataaatgtgaaaatgtgaagtcataaagaactagatgaaaattcaggaaaatattacagtgtaagacatcttgaattggcataagcaattcctgacattacaccaaggctataaacaattaatctgacatagttaaagatgtaaaaattaaagtatcatctaagtcaaaagacaccataaacaaccgtttaaaaaggcaaattttaggcggggcggggtggctcacgcctataatcccagcactttagggggctgaggagggcggatcatgaggtcaggggatcaacaccatcctggctaccacgacgaaacctcgtctctaataaaaatacaaaaaattagccaggcacggtagcacgcgcctgtagtctcagctactcaggaacctgaggcaggagaatcgcttgaacacgggaggcagaggttgtaaatttaagaggaaggagaagatttcaataagcaatggtgaggagaaaaatactagaatttattgaaaagtgtaaagtttagattgtaaattaaaaaaattatagtcttgaactaaatttgcaggtattataaacatggaagatgggaggagggacagaaaagaaaagagaagttattttggtgttcaaggaatgcatacagatactaatgaatgatagaatggtagaatggttaaaaacacgagcattttattttgttttattttagacagggcctcactctggtgcccaggctagagttccatagcacaatcgtggctcaatgaagccccagcctcctcagctcaagtgatcctcctgcctcagcctcccatgtggctgggacttcaggtatgaaccaccacccctggctaattaatttttttttggtagagacagggtcttgctatgttgcccaggctgaccttgaactcttgtcctcaagcaatcctcccaactctgcctctcaaagtggtgggattataggagtgagtcactgtgcccacttaacactagtattttagagtacaaactctggaaccagacagcttgggttcagtttctggcttcccaacttattaagctatgtgaccttgtgtaagtcatataacctttccgtgtttcaggctactccagagtaaactggggataaccacactatctagctcatttgattgctatgattaaatgggcaagtacgtgtaaagcacttagaatagtgcctgtcgtgtggttaagttagtatatatcttttacttgttgttagtaatgacttcaaattacttttaaaatgtaaaggcatatctggttcaagaagaagatggtgaaccaggaatagctgctggcttccttcccaaacccaaccctgcagatgccacagaagaggtgggaagtggttggagttcagaacagttcctgtaacaaaacccttgatggtttggccccactgggggatgagacggcttagagtgggaaaaggtcagaggccacagatggaggatcagcccaggtggagctttctaagttgcattcttgttttctccttgttttctggaaggcttattacctgttctgtaaacatatagagcagacatttggcagggctggcctagtgctagcccaaagtggcgtgataacattaaggaatagggggcttggaaagctcctagaaaaagtgcagactcatcaaagctggccagtaactgagcattcctttcctacctcttcctctgccctctgagctaggcaattacaaccaatatcacccacccgtagactccctccactctgtaaggcagaaatcctgtaagcatctctgggggctaataggctaggaactggaaagaattggctcagctcagctcagctctagaggctgtgtatcctatgacctatcaatccagaaaccctgaaactcacatgtagtttctggggtgacacatttttcccagggacaaagagttatatagaaaaactatcagataggccaggcgcggtggctcatgcctgtaatcccagcactttggaaggcctgaggtcaggagttcgagaacagcctggccaacacgggaaactctgtctcttctaaaagtacaaaaattagctcggtgtggtggtgtgcaacggtagccccagctactcgggaggctgaggcagtagaatcgcttgaacccgagagtcggaggttatagtgagccaggattatgccactgcaccccagcctgagtgacaaagtgagactctgtctcaaaaaaaaaaaaattcctttctttcaacactttggagttattacaccattgtatccttgcctccagtgtggtgtttgagagacccaatatcagtttaattatttttcctctgtaagtaacctgctatttctctctgatcgttttaaaactactttttcttcctttcacaattttacatttcactgatcctgtgtgtgtgtgtacttataaatacctttaaatcttaagtcatttttctaaatctgagaaattctctttcattacttatttcagtacactctcttgtttaatgactatattctcttcttataaggctactattagatgtgttttgacatttattcttttatcctccctattaattaacttttctttcatttacttcatctgtatccattaccgattagttttatgaattctttagactcatttcctcaggtcagcctttgccttttcaactatatccgttttaatatccaacctatttcactgaattatttatttgagcatttaatgttttcatatccaatctatccaataggttattttttatttatttatttatgatggagtctcgctctgtcacccaggctggagtgcagtggcgtgatcttggctcaatgcacctcgcctcccgagtccgagcagttctcctgtctcagtagataattaaaaaaaaaaaaaaagctgcatttggtggtgtgtacctgtagtcccagccactcaggaggctggtgcaggaagattgcttgggccctggagtttgaggctgcagtgagctaggattgggtcaccgcactctagcctgagtgacaaaatgagactttgtctctgaaaattaaaaaaaaaaaaaaagatcgtaggcacgattttactcagaagggggagtaatatgagatgtacacgggccactgcaatgggtttttgtggtaggagagatattgggatcgacttggactccaccaaggacaagtggggatttatagtcaagagcagggtggtggggagcagggtcagaagatgggaaattacttggaggagacatcaggtgcagggggattctggctaaacagagttgacaggaattttgctgaaacaggcttaatgggcagagtccctggatggggaggtgtgagccacctcacctggccaacaggctatgtttaatatgtcagttttcataagtaatctaggtataattgttaaaaatgaataaacgaggtaaatgtgagatacatgtttataaatgaacttttcatgtaattggaaatcttttttctcttgctcttatcataggaagatgaaatattaaagttatgttgtgttagattaagtaataggtactcattaaatgtcgggatctttccaactaagaaaacagctgaaacaaatcgctaaacataaatacaagtttgttcttggcccttaagttttataaaacacaaaagatacttggatccattaataaaatgccctgttctacattgaaaattgttctggctgggtgtggtggctcacgcctgtaatcccagcactttgggaggctgaggcgggtgggtcacgaggtcaagagatcaagaccatcctggccaacgtggtgaaaccccgtctctactaaaaatacaaaaattagccgggcacggtggcgggcgcctgtagtcccagctacttgggaggctgagtcaggagaatcattggaacctgggaagtggaggttgcagtgagccaagattgtgccactatactccagcccgggcaacagagcaagacttggtctcaaaaaaaaaaaaattaaggttactaaaaattaaaagttcttagtatatgtagttccatatacaaaatatacagaaaacaatttttatatcaaaaaattttg

SEQ ID NO: 634 - DNA, 7371 bp, Homo sapiens
aaagtcttcagccattaacctcattcagcaccagtaaaccatcttggagaaagaccttaggaatgcaggcaggcaaagtgcttttgccagcagataaaatagtaaagctgtggatattagcttttgtgagggagacctcaaccagaaatggaatcttacatccaaacatccacacaagggaggtttgttgtaattgtctgctatatgagaagcttttgtgaattaccttgcactttctgacctgcctgggatccttgccagtgttaagtcactgaaagtgtgtactacaaaagacttccatccactattagctgatatcacagtgtgtatcaccttaaaatgcttagggagggcagatagctgtgctctctacctttatctggagttattgagtctgatcccttcgggcgaggcctcattcccacttccatggctggtttgggtgcagacatcatccaactttggacagaggatacaggctggcttgagctggcagcttgtaaagattttcctttcttcatgggtattattgcttgtcttataatgttggtgatagatttttcaccttccaagctgcccaaacccagtcaatttccacgtgactatactggttttagtgatgataaagtcattgtttaagctacatttactcattgcagttttattctctgtgtgctgtgggttgagagcaaaattggagtctgccaaaatgaaaaagtgagtggttttgtgaggttttcaattttatgtacttccaaggaaatagcaaaaacaaaaaaaccaaaaaaaaaaaaaaaaaaacaactcaatccacaaacgcctgatgtatattgcttcagaaggttcctgggaaaaagaaggatttctatccaaaatcctttaccctgaatttgaagattatttatggttgcacagtcagcttgcagccaggacaattggtttgacaactgtcaggatttatggcagctgtgagagctgggtatttgtacccatgcatgtcccatattctccagtattgtttagggatagcttgctcctgtgatgtgccttatgagctatgtgtcttgaacccaaaaatgatgtaggttatgttcctggatgtaaaatgtaagagtgcattagtttgttgtccattgcttataaaataatacctgaaactgggttatttataaagaaaaatctatttcttacagttatggaggttgaaaggtccaaggttgagtggccgcatttggtaagagccttcttgctggtagactgtgcaaaaagtcccaaggtggtacagggcatcacatggtgaggctgctgagtgtgctcacatgttaacgtgctagcgcaaatcattctctctcttttttttttttttttttgagacggagtttcgctcttatcgcccaggctggagtgcaatggcgcgatcttggctcactgcacctccgcttcctgggttggctcaccgcaacctctgcctcccgggttcaagcaattcttctgtctcagcctcttgagtagctgggattacaggcatgtgccaccacaccccgctaagtttttatttttagtagagcagggtttctcccatgttgatcaggctggtctcgaactcctgacctcaggtgatctgcccgccttggccccccaaagtgctgggattacaggcaagagccacggcccctggccctttctcttcttataaaaccaccagttctcccaggataacccattagtctatcaacccataaattgattaattcattcctgaggatagagccctcatgattcaatcacctcttaaaggtcgcacctctcagtactaccacactgtagattaagcttcaatgtgacttttggaggagatggtcaaaccatagcaagcagtttgggaaccatagtctgtacagaaacagtgattgtattaatatgaagtatgagacaccagcaaactagagtggaatggatgagcgccttgtaaagagacatccatgaatgtttcagtaactatggctatgtgagatgagggtatacagaaactctgaggacctacagacgtgtgtatctcctgtaggcaaagtcattgtcagagcaagtaatccaaaggtgttatggattcttgtgtctctggcgttataaaacgtatgttgaattttaattgccattttaacagtgtggagaaatgggacctttaagaggtgattaggtcatgatggctctgcccttataaaggaatcaatgcctttatcataagagtgggtttgttaacccgagagtgacgtttttataaaatcagctgtctctgtctttcatgctcacttgcccttctgtcatattatgacagagtaacaaggccctcaccagatgccaagcagataccagtgccatacccttggacttcccagcctccagaactgtatgaaacaaactactttataaattacgcaatctgtggtgttttgctatagtagtggaagacagacacagacataaagcctgttaattcaaaccactactgcacaggtaggagcctcatgactgaatgaagggagattctatacttctgagataagtcttttttttttttaaacctaaacataattcctggtgactcaggtggacataaccttccttgtctccagttcttcttccccgagattctgaatttccaacaacattgcttccagtttttgatactataaaatcagagttgacccacgtaagacatgaggagaggctaatgatggaatcaacacagctttgccagaggttataaaagaggattgagaaatccagattttatttggaatttttcttttctaacagctttattgaggtattagtgacattcagttgcacattgttaaagtgtaaaatatataaaaacaatcaccaaagtcatgataataaacatatccattgcctcaatagtttgtttgtacccttttctattctctctcgctcacagtcctacccaaatttttatgctcaggtagccactggtttactttatgtcactatatacatctttccttccttccttcctccctccctcctgctcttttctttttccttttttcttttcttttttctttgtttctttccctccctccttctcttctcctctcctctcctcctctcctcctcctctcctctcctctcttctcttctttctctttctcagaatttcactcttgttgcccaggctggagtgcaatggcacgatctcagctcaccgcaacctccaccttctgggttcaagcgattctcctgcctcagcctcctgagtagctaggattacaggcatgcgccaccacgcctggctaattttgtatttttagtagagacgggggtttctccatgttggccaggctggtctcgaacgcctgacctcaagtgatccacctgccttggcctcccaaagtgttgggattacaggcgtgagccaccatgcccggcctataaattttctagtatcttatacaaatgaaatcctacattacattcatatggagcattttttgatatttatacatgttaagcgtattcattttttgttgatgaagagtattgcattgaatataccacaatttattaatctattaataaatattttgattgtttctagtgttggactaaaaaactaacaaagacccatgaacattcatatacaagtgtttatatgaatatatttagcagaattgcatttgttatacctccttgtccatgatggttatggtgtattttaaagattaaccattttcatagatgtgttgtggtcagtgtggtttttaaatttgcatttctctaataattaatgatgctgaataagtttttatatgcttatttgttatctgtatatttggccaaatttctaaatcttttccctttttttaaaaaaaaatcttatttttctattttaatagagttttaattttagaacattttaagatgtacagagaaattgcaaatatagtacagagatatctcatttacaagcacacctagttgttactaatatatagtcatatattagtatacagcattatttacaattagtgaaacagttttgatacattattaaactaaagtacatctttgattgagatttcctcagtttttaccaaaatacatgttctgttccagaattccacctaggataccacattgcatttattttattattttttattcttttatttattttttttcatgtgtctctaaatgtaaccacattacagttagtactcacatttctttaggcttgtcttgcttatgagaatactcatttattttgatattgatttttaatttttttttttttagatagtcttgctctattgtccaggctggagtgcagaagcactttctttctttcttttttttttttttttttgagacggcgtcttgccctgtctcccaggctggagtgcagtggtgggatctcgactcactgcaacctctgcctactgggttcaaggattctcctgcctcagtctcctgagtagctgggattacaggcacctgccaccatgtctggctaatttttgtatttttaatagagatggggtttcaccatgttggccaggctggtcttgaactcctgacttcaagtgatctgcccacctcagcctctcaaagtgctggggttaccggcgtgacccacggtgcccagccacttttagttatttttatttttattttgagtctccctccgtcacccaagctggtaagtaattctcgtgcttcaccctctggagtagctgggactacaggtgtgtgccacatggttggctaatttttgtatttgagacagggtttttgccatgttggccaggctggtctcgaactcctggcctcaagtcatcttgagtggatcacttgaggcatttgggagtgcctcagcctcccaaaacggtgggattacaggcgtgagccactgtgcccggcctgcacatgtctttcttacatgtggactctccaggggatttatgctgttcaagaagcacctgaatcaaactgtgctttaaaaatatttttaaaacattccatgattcttcatagtacaaaaatgagaaatctcccctaaatctctaaagaattccctttttaaactttttgatttcctgaacttgtctgaaggacttaacacagttatatagagtgttctttgtgtaacagtatccatgactttcatttttagctctggtattagatcttcctggacaagagcattactggccatgtgtatgttgctatcacaaataactagtagttaatatttcctaaatcttagcaagagttatgataaatagctgaattccatgaagagaaaagactcatggcatgacaaccagattaggaaagagtgttttccttgtcctgcaggcaaaacagaactgagagatatgagtatcactcatgatgaggacaaaagggctgcgtgctgggaaacatgaggcgaccaacacagagttggtcactatccactggcctgggtttgcaactacagttgtccaaattgtcagaaaactatggactgaatagaaaacaaaaaaggagctcaccaggaccatgatggtgtgtgtggctctggcttcctgggaaggtctgcaggagagtctgttgctgtgattgtgttggacttgctgcttgtgtctgtagaggaagaagaccatggagccactggcccagaccatgaagcccaaactcataaaatcaggggaaaaatataagactgcatgtaatgagctaaatctctttgatgctttgtaagaacagtatccataattgttttttgcactactgtttttgctattcagtgggccattcactaatagaagaacagatgcattcatcaagacatggggggcccagcagaggagacaacagaagtcaataaaccttggggatctaatcttgatctccatccacctgcatatactggggttgagcttaatggcttggaatccattgagaaggcagatggtgctgagggaaactcttgtgcccaccctgtgataataaaagacaaacttacatccagtgtcattcagcaaatatttcaatccaaaagctgccattgtctgaggtatccctttaaagaaaaggaccatggagttagccaaggccagttggctgagaatcaagtccgtgggtctcagcttgtgtccagtgaacaaaattaagttataaaaacaaaggagaaaggaatttcccaggatcccaactccagtctgaatgaggaagctaatccctgattttacttttccaaaagccatttcatcaaaatctaggggatgttgattttcattgaggtctgaagaatcagtagaataaaaaagcagaaagaagtatcttgtcatcagtggagacagaagttttaatgtgtctccaaccatattttctcatcttaaacagaaattaagattgtccctgttcgtgcaaaggcaattgcttgtgtgtccaactgcagagaagcaggtgaatgaatgagggctcaaccgcacaacagatccacaaatcaaacctataaaactcagggcttacacacatgcaacaagtaaatacaagcaaaactagggaaatatataaaaacagaacacagaagagtcaatatcattagagtgatattatactatagtttgcaaaatgtaatcatgacggaaccctgggtaatatggacagggctttttctgtattatttcttatgactgcttgtgagtctacacttatttcaataaaaccttcaattaagtagcctggagatatgaaaagcaaaaataatacaccataaaaccttttccacactaatattttagtaaacaccattgttattgatgcattgaaacaaattttaggccgggtgcagtggctcacacctgtaattccagcacttcgggaggccaagatggagaccatcctggccaacatggtgaaaccctgtctctactaataatacaaaatactaataatacaaaaattagccgggcatggcggcgcgtgctagtcccagctactcgggaggctgaggcaggagaatcgcttgaacctgggaggcagaggttgcagtgagctgaaatcaaaccattgccctccagcctgggcgacagagcgagactctgtctcaaaaaaaaaaaaaaaagaaattaaaaaaacgctacaatacaattggtaacaaggccttcagcacagtacaaatgctaacttgaagaatttttaaaaactataatttttggaacaatcaacattgcatcatggtatattttattttaagcacatatatttctgttattttccaccggacaggtctagagattgtgaattgactccgtagaaataaccatgaccaccttgagcccacacatttttatctcaatg

SEQ ID NO: 635 - DNA, 13424 bp, Homo sapiens
ccttccctggttaataaactttttccattctatcatcatattcattccttaagttccagtaacttctccattgatttgttcccttcctctccatcccccctagcattatgccatccatagttttatggcaaacaaactctgtaatcagtctcttttcatccgctttgctccagaccagtatactccaaccactgcttccattacactccaactcaaagcccacgagtgtctctgttttctattacattactagggaacagctctggctgacctaagaccctctgtagtctgactagttgccagcatgcagtgcctgctcttgccagcccatctcttcactgtcacataaatatgccgagcttggcctctcctctctgcctttgtaggttattcatcagaaatgttttcgcatgtctatctgactccagattcctgctatctatacgtgcaacaatggcacctttctaaaagactttcaaatgattacttcatgtccaggcctttctcatttttttcctgatggctcaatggacagaacatgaggtggattgtcagggagtcccgcatcttatatttcagttccatctggtgctgcaggggctgcattctcccatgctccttctgttcctctaaaaaataagctactggcaaacagagcagtgaaccccagtccacagcaatgcttcttgtcccccaagcgagatctgctctggggctaattcattaggtttagcttttgtctcacttgatcggaacttgggtggagattccaagggctggaaggaaaggtggggagctgtgcggttctaaagggtgggaaccactcctcaaaagcgcaactctgagaacacactgagagaaaacaagctcaatcttggtagtagtacggtcaccatttacagatttctttttacagctgcaaaaatattccatcaggttatcagcctctgacttcatttcactttggtaagtaagtaaaaataaagctactgtgaaatgccatcagcaatgtgagctcacggcgggtagtccacgtttgtgaaaacagaccctatagactgctctgcattttagttttcatggaggctattctaaaggaaacttgttatttcatatatttcatatatggttatacttacatgccagctaaactacacatgcacacagattttaaatagcatcagaaaataaggtttttgtttaccttaataccatttaccagttgccttaatgaattctgtaaaaatacccttgcaggcttctgctcagttacccaagagggcaacacagctgaaaaacccagcagctgaggaaggacccaaagagactcagtatgacccaaagacttacagacacagccaaacaatcccaaggagtacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttca

SEQ ID NO: 636 - DNA, 14040 bp, Homo sapiens
ctctactgccatgcctacaaagaaatccaagaatgatataaatccagaggatctttgcatgctgtaagggagattctccacattctgccttttcactcctgtaacaaatgtttagaaacatttcctagacagcagagatgagtgaacaagaaaagcagtcccaaataaagcatgcatgccatgtaaaaatacttcactaatggtaattgtattgacaaacaatgttatgccctgacaaaaatttaaatgtagtacaaaaatgtaaaggtagtacaaaaatcactctaagaattcaatgtttctactcagatatcacaaactgtgtttttaaattagagagatatattcttaatttgctgcttggaattaccaagtgactaaacatgtttgccagaactgggagagcaaactgctcaagaaatttcctagaaaatgaaagaaaactgtttaaattatagttctaattggccccttatctggggctgagggattgatgaaataattattagtgtacataatggtgaggtttgtgtaaagataaaatgaaagagtcctaattaactccaacaaactttgacatatgtaagtgcttactccctgaagattgattttcattttactaatgacactggaggtgacaccatgaccacgtgtcgtgaggaaatatgcattagccttctgattctgtcagtagcattaatattcttgattgccatttgtagcatttttctagtcctcataatgacatgaaatttccttcctttctatagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcaggtaaaaatttggaagagtcagattggatttggtatgcttctaatcgtcttgaaagtgagttgaattaaccatgattgctccattgcttgctttagcataatttgtcctgattcatttacctaaacatcataaaattattttctttaaaataattatttcattttatttgttctcagaactttttctccctgtttccacaaatacagtcatctaaatgcttcaattttctcccaatccttgtactcatcttcaggttaccatgaaattaaagcagttcatttattcttctaataatatactcattcaatatagcatacacttaagatttagaataaatcggttcaccttctttttttccagtgatactttacttgaattacagtgtacttccttagaactcttttatgttacccttcaccacaaaacccatataaattacactttgcaaatagtaaacattgcccttccttgacctactgccttcctgaagtctatatgtaaaataaataccaatctgctccttgactttgaaaacattacattattctcagcttttagaaaaagcatatctgataaaaggtttctaatgactgaggaattaacagctctatttgaattttaagatatcttgcctatcacctggaaggtgcagaaaaataaagaaataaggaatacagaaattttctgagtagatttttatgactttggacaaagtctcattgaggtcttttatgtccctctaatgttgtatattaagaaagtatctggttagacatttacttaggggaacacaaacatgaatgttgataagaacaatatgaaaacaatagaaagaggaggatcagggataggtatagggaggaagaaataacaaatgctaatgtttttatgctcaatgataatatatgagtctcaaataaaagtgcactgaaaatgaaggtttgtcatatatgttcactgccctatactgaaacctagaacagtgtttggtactggtactcagcatgtcatatttttaaagggaacaattttttcctttatgtccccctacacacaccagtacataggtcagatacacatatacatacaagactaagaattaactgtgtccattgtgtattatagttatagaactgaaccaaaaatatgacttttgacctctaacaaattaaacaaagcttataatcattaaaataaactctcaaaacagttgactttttctctaaaacatattatggccctctcagaaggaaggaaggaaggaaggagaatggaggaagggagggagggaaaagaaagaaaaaaaaatcccaagatggcccactagactcaagacaaatggaacagctcctactgagggacccagaggactagagtgctcctaacagatcttcacagggaaggcactgagagtggacagagggaaaacacagaggttgggctgattgggggaaaacgttgggacccctacgcggggctacagcacacccggatttatttctggcccccaacagctctgggggaattggtgagttgaactggcaaggagcaacccactcttgccacaggcctctggaaccccagcagaaggagaccccctagaccaccacggactctggacttggcagggagagctgcatacagaagtggtaggagctgcaagccagctgatgtggagcccagagggtttggtgcaagagcatctgtagtgaagcatggtcagggatggccatccccctaggttcgatttgctccataggagactttagccctaggggaactttctgtctgtcctgaactctgtaaggcagttttgcccatcagatggggccagtcccacctaagcaacaccttagtctgctggcctctccccgagcctcagtatggccacacctgcttgcagggcgccctcgggagccttgagaggcctcacaatagcttctcctctggcagaccctgactgaaaggcagagagcttaagcagggcggctcctatggccactcaccagcctgcacagtctttccccacactgcagccgcagcgtccccgacatccctccatgggacaactcccacatgagtttgctgggcgtgtctgcttaggggtaggggtggggatttgggtttgctttccttgccctgacagcgcctggtagtacagtctgctccccttcccctgccaaccaccgttgcagacagagtcttagtgggtacagagccagcaagccctgtcccaacaagtaccccacccttgctttaagaatgcgcagatgacagcggatcctcccccaccttgagtgacccctccagcttgcagagcagagaaggcacccagacctgcacctgtcagtgccctgcccccagccaacaccacctccagtgcaagcaggcacacagttgtcatcaggcacccgctaccaccaccatcgctccaggcccaacctcaactgcattgcctccgccactgtggtgaatgtccccagggagacaggcacccaggaacccgctagcactcaaaaatagaaagattcaatatcattaaaatgaacatactgcccaaagcaatttatagagttcatggtatttctattaaactaccattgacattcttcactgaactactaaaactattttaaaattcatatgaaccaaaaaagagtcaaaatagagaaggcaatgctaagcaaaaagaagaaagctggaggcaacatgttacccaacttcaaactatactacagcgctacagtaaccaaaacagcatggtactggtactaaaacagacatacagatgagcggaacagaatagagagtgcagaaatatgaactaactcctacaaccatctgattttcgacaaatctgacaaaaacaagcactggggaaaggataccctattcaataaatggtgctgagataactggctagccatatgcagaagattgaaactggaccacttcctttcactgtatacaaaaattaactcaagatggattaaagacttaaatgtaagatacaaaactatcaaaatgctagaaaacaacctaggtaatactgttctggtcataggaacaggcaaagatttcatgatgaagatgacaaaagcaattacaacaaaaacaaaaattgacaaatgggttctaattaaacttaagagcttctgcacagtgaaagaaactgtcaacagagtaaacagataacccacagaatatgataaaatttttgcaaactctatatctgataaaggtctaatatccagcatctataaggaacttaaacaaatttacaagaaaaaaacaaacagccccattaaaaagtgagcaaaggacatgtgtagacacttttcaaaagaagacatacacgtggccaacaatcatgtgagaaaaagctcaacatcactgatcctcagagaaatacaaaatgcaataacattaaaaccgcaaatgagataccatctcatgcctgtcacaatggctattactaaaaagtcaaaaaataacagatgctggcaaggttgcagagaaaaaagaacacttatacactgttggtgggagtataaattaggtcaaccattgtggaagaaagtgtgacgacaactcaaagacctaaaaacagaaaaaacattcgacccgatactcccattactgggtatgtgctcaaaggcttaatacctgggtgatgaaataatctgtacaacaaacccccatgtcacaagtttacctatgtaacaaacctgcacatgtacccgtgaacttaaaagtttaattgccaaaaaaatccacatgatcaaattatcacattaaaagtaaataacaatacaaaagatgttcagtttttttccatataaaaattaaacaaccaaaaaaaaaaggtaaaatggcttaaatatgttggaaaaggttcatccacagaaaatccaacttctccacttttgtgatttgcctattataagttgtttttttctgctaccttttcaatagcatgaattttaaattaaacattaattgcctggttagattttcatgcatccataaaaccagccatgctttcattgtgtacaggtgttcattaattaagagcataacaggttagttgttcttcattttatgtactcactgtgcagctactgaaatgactgccaatagtagtacttatgctcacatattttctaaaaagcgctgccttactttgcatattgttaattgtgtttaaacaaaggcaaagattactgactaattcagaggctctctataaatattcatttcaaaaataaataatccatttgggatgaataatccttttcaactttttatggtatgaatctccttgtgctattaaaaagcattttagcaagatcacttttacatttcaagctaaagtgtattcagattgtgcattttaaaagaatttctatttctgcagctacctcaatcatgtattgcctgtctctattttatcatgagttctatatacatgacatactttagtccattaaaatcttatggaagagaagtagcatgaaaaatgcacgaagtactctcctttgaaagtgagttgaggaaggtttgtattgcatcctttatgcttcctgtactgtggtactacatagggttagagctactaatggtgttgagccaagtgttgagttatgtgcctgttttgtcaggcagcacagatttaaagagacaccaatgtctggagacatcctctcaaatgatgcactctgcctctattaagtacatatccagtattttaaaagataatgctgctctaaagagccaactaaactttgaaaatagagctgcttgggagaaaaaaggtctcacattagggatgttgaattgaaagtggtatgcctctttaaggttcacttatttaatagaatattctaaattccaaagcagtgcagtgaactattctgtcatagaattgccccttttctgcatgccaaaaaacagaatttttctttacaatttttctgaagagtatattttgaattttccggtcatcaagaaatactcggtcaggcacggtggctcatgcctataatctcagcactttgggacgctgaagcataggtatcatctgagcccaggaattcaagaccagcctggccaacatggcaaaaaccatctctgctaaacatataaaaatcagccaggcatggtggcacacacctgtaattttagctattcagatgactgaggcatgagaacccgggaggcagaggttgcactgagcagacattgcaccactgcactccagcctgggtgacagagtgagactctctcaaaaaaaaaaaaaaaaaaaaaaaaaggaaagaaacactcttgatagtcagcaaagctaagataaattggttcagtccaatttcttagtattaggatgtcaaaatcataatacaaatatatatttttatgcacacatttcacttttaatttatgtgggtatacagtaggtatatatattttggggttacatgagatattttgatacaggcatacaatgcttagtaatcatatcaggataaatagggtattcatcccctcaagcatctatcctttgtgtttcaaacaatccaataatacacttctggtcagtttaaaatgtacaattaattttttttttttactatagtcaccctgttatgctagcaaatactaggtcttatttattctttctaatttttttttatatccattaaccatcttcccttccccccaacccccactaccaactacacttcccagcctctggtaaccaaccttctactctctatttacatgagttcgattgttttaatttttagctcttaccaatgagtgagaacatgtgatgtttgtctttctgtgcctggcttatttcacttaacatgatgatctccagatccatccatgttgttgcaaatgacaggatttcattcttttgtatggctcaataatactacgttgtgtacaagtaccacattttctttatccattcatctgctgatggacatttaagttgcttccagatattggctatggtgaatattactgcaataaatgtgggagtgcagatatcacttcaataaactaatttcctttctttggatatatacctaggagtgggattgctagatcatatggtagctctatttttagttttctgagaaacctccaaactgttctccgtagtgttgtactaatttatgttcccaccaacagtgtatgagtgtttccttttctctagatcctcactagcatttgttattgcctgtcttttgaatataagccatgtaaactggggtgaaattacatcttattgaagttttgatttgcattcccctgatgatcaattatgctgagcacattttcatatgctcagacttatatgtcttcttttgagaaatgtcttttcaaatcttttgcccattttatgaattgggttttttttattttttttcctacataattgacttctttatatattctgtttatcaatcctttggcagacaggtagtttgcaaatattttctcccattctgtgggttgtctcttcacttgtttactgtttcctttgctgtgtagaagctttttaaattatcctatttgtctatttttgctttagttttctgtgcttgtggtatattgctcaagaagtctttgcctactccgttgtcttgcacagtttccccaatgttttcctgtagtagtttcatattttgaggtcttagatttgaatctttaatacattttgatttgatttttatatggcaaggtataagagtctagtttcacttttctacatgtagctatccagttttcccagaactatttagtgaagagactgtcctttctttgatgtatgttctgagaatttttattggaaataagttcattgcagatgtatggatttatgttggaggtcctctattctgttccattggtcaatgtgtctgtttttatgccagggccatgctgtttttatcactgtagctctcaagtataatttaaagtctggtaatgtgattccaccagttttgttctttttgcttaggatagttttggctattctagctcttttgtgatctgatataaacttaagaattgttttttctatttctgtgaagaatatcattgttattttgatagggattgcattaaatctctagattgctttggatagtatggacattttaacaatattgtttcttacaattcatgaacagggaatatctttctattattttgtgtccttttcaatgtattgcatcagttttacagttttcattatagagatatttcatttatttggttaattcctaagtgttgtattttatttgtagctattgtaaataagataagtttcttgatttctttttcagattgttcacagtttgcatataaaaatgctactgatttttgtatgttgattttgtatcctgaaaatttactaaatttgttcatcagttctaattgttttttgatggggtctttagattttcccaaacataagattatatcatctgcaaacaagaaaaagttgatgtcttcctttccaatttggatgccttttatatatttctcctgtctgattgctctagctaggacttccagtactatgctgaaaaatagtggtgaaactgggcattcttgtcatgttccagatctaggaggaaagactttcagtctttccccatttaatataatactagctgtgagttcatcatatgatttttatgatgttgagttatattccttctatacccagtttgttgagaatttttatcatgaagagatgctaaattttatcaaatgctttttcaacatcaattgaaatggtcataggtgttttgtccttcattctgttggtataatgtatcacattgacttatttgtgtatgttgaatttgccttgcatcccagggataaattccacttggtcatgatgaatgaactttttaatgtgttattgaattcagtttgctggtattttgttgagaaattttgcattgatacttaccagtgataccagtctataggttttttttttcttttttgatacgtctttgtctatttttggtaccaggataatactggcctcatagaatgaatttggaagtgttccctccttctctattttttgaaatagtttgagtaggattggttttagttcttctttaaatgtttggcagaattcagcagtgaagccattgagtctgaggcttctttttttttccctctggatgcccatttattacagcttcaatcacacattatcgatctgcttaagttttgaatttattcatagttcaatcttgataggttgtatgtgtctagaaatttgtccatttcttctagatattccaatttattggcacatagttgctcatagtagcctctaatgatcctttgaatttctgcagtgtgagatgtaatgtctcctttttatgtctgattttgcttatttgtgtactctctttttttcttagtctggctaaagatttgttcattttaactttaaaaaaacctttttgttctattgatcttttgtattgttttcttcatttcatttatttctgctctgatctttattgtatttttcttctactaattttgggtttggtttactcttgcttttctagttccttaggatgcctcattaggttgtttatttgaagtttttctttttcttttttttttttttttaatgatttaggcacttatagctatgaagtttcctcttaggattgcttttgctgtatcccataggtcttggtatgctgtgattccattatcatttgtttcaagaaatttttcaattcccttcttaatttcttcattgacccatgggtcattcaggagcattttttttgtgacctaacatatggcctatccttgagaataacctatgtgctgaggaaaagaatgtgtattcagtcattggataaaatgttttgaaaatattaggtcgatttggtccacattgtaaattaaatccagtgtttctttgttgattttctgtctggaaggtctgtctagtgctgaaagtgaggtgttaaagtctccagctattattgcagtgaggcgtatctctctttccttacctctcataatatttcctgtgtatatctgggtactcaagcattgagtgcacatgtatttcaaattgttatatcctcttgctgaattcacccctttatctttatatggtgaacttctttatgtcttcttatagtttttgtcttaaaatttatttttttctcatatgaatatagctactactgctcttttgtgatttccactggcatgaaatatgtttttctatccctgtgttttcaatctatgagtgtctttataggtgaagtgtgttgcttgtaggaaacaggttattgcgtattatttttttgaccattcagccactctgtcttttgattagagaggttagtccatttacatgcagtgttactattgataagtaaggacttactcctgccattttattatttgttttctggttgttttgtggtctattcttccttctttcctttcttcctgccttcctattagtgaaggtgtttttctctagtgatatggtgtaattttcattttttgtgtatcccttgtaagttttttgctttgaggttaccacgaggtttgcaaatactggcttataaccaattattttaagccggtaataacttatcactgtttgcaaacaaaacaaacaagtaaaaagaaaactagtaaaaaatctacatcttaaatttaatcacctcctttttaactttctgctgtttctatttatatcttattgtactgtctatgtatttgaatgttgttgtagttattattttttattggttcatcatttagtctttctgcttaggataagagtagtttatactccacagttacagtgttataatattctgtgttttcctgtgtacttactattaccaatgagttttttacattcaaatgattatttattcctcattaatgtccttttctttctgattgaagtattctctttagcatttcttgtgggacaggtctggtgttgatgaaatccctcagctttctttgtctgggaagcctttatttctccttatgtttgaaggatattttcaccagatataatactctatggtaaaagttttttttcattagcactttaaatatgtcataccgctctctcctggcctgtaaagtttccactgaaaagtctgctgccagacatattggagctcctttgtatgttatttgtttctttctcttactgtttttaggatcttttctttatccttgagctttggaagtttgattattaactgtcttgaggcattgttctttgggttgaatctgcttggtgttctataaccttcttgtacttaaatgttaatatttttctctaggtttgggaagttctctgatattatccatttgaataaacttcatacccctatctctttctaccttgtctttaaggccaaaactcttagatttgcccttttgaggctattttctaaatcttgtaggtgtgcttcattattcttttttcttttgtctagtctgacgtatattttcaaatagcctatcttaaagtttactaattctttcttctgctagatcaattctactattaaaagactcatgctttctccactgtgtcagttgcatttttcagctccagagtttgtgttggattctctttattatttcaatctctttgttaaatttgtctgatagaattctgaattctttcttggcattctatttttttttttttttttttactttcctcataacagctattttgatttatctgtctgaaaggtcacatatctccgtttctccaggattggtccccggtggcatatttggttcatttgctgaagtcgtgttttcctggatggtcttgatacttgtggatatttatctgtgtctggccattgaagagttaggcatttattgtagtttttgcaggctgggcttgtttgtaacctgcctttcgtgggcaggcttttccaggtatttgaaaggacttgcgtattgttatctagctgtatctgctttaggggacaccccaagcccagtaatgtagttcttggagactagtagaggtactgccttgataatcttgaagaaggtctgaaagaattctctggattaccaggcagagactcttgttctctttccttactttctcccaaacaaatggagtctctctgttctgagccacctggagctggggatgaagtgacataagtaccctggtggccaccaccactggaactgtgctgggtcagacctgaagccagtccagcagtcgatctcacctatggcctgctataaccacttgctggtgactgcctatgtttgctcaaggccctggggctctacaattagcatgtggcaaagtgagccaggccagtgtccttcctttcagggtggtgagttcccctagggcctaggcggatccagaggtgccattcaggagccagggactacagtcaaaatccttagaagtctacttggtgttctattgtactgcagctgagttgacactcaaaccacaaggcacagtccttcccattcttccctctcctttccaaaggcagaggagcctcaccacgtggccactgccaccacaagcccacaggtagtactgccagtctactgccagtgttcccttaaggcccaaggtctcttaagttagcttttggcgaatggtgcctggcctagaactcacccttcagggcaatgggctcccttctgtccctgggcaggtccagaaatgctgtcaaagagtcaactcctgggatcagggaccccaagagccctcttagttctctacacctctgtggctgagctggtacctaaggttcaagacaaagtctcctttacttttcatagcagatgattaatcctgccaagactgggtctttcccttcaaggtagtgggttcctttcttgcccaggatgtgtctagaaatgtcatacaggagctagggtctgaaaagagggcttcacaactatgaccagtgccctattctcctgtggctgagctggtatccaagaagcaagaaaaagttctccccactcttcctccttctctcctaaagtgggaggaaggtatctcttatggatctgcaagctgtgcagcctggacttaggaaaggggtggcatcaacactcccctagcactctaccccagctcacattttagatgccacatattctccaagtccactatctctgagcccagttcaacacaggacttgcctaggagttacagtccttgtggcctagactacctttcaagtttatttagggccccagagcacttgagcctgtggtggtgaggctttcaggaattcaagttctgaccactgatatggaagatttccctctggctagggatggtttaaatattccctccgggccgggcgctgtggctcacacctgtaatcccagcactttgggaggccgaggtgggtgaataacctgaggtcaggagttcgagaccagcctgaccaacatggtgaaacatcgtctctactgaaaatacaaaaattagccgggcgcggtagcgggcacctgtaatcccagctactcgagaggctgaggcacaagaatcacttgaacccaggaggcagagattgcagtgagccaagatcgggccattgcactccatcctgggtgacatagcgagactctgtctcaaaaaaataaaaaatttaaataaataaataaataaattccctctgtgggtgggcatcagctgaatttggtctggttttgctttcttctataaccaagcgacactgaatttaatgtctcacaattgttgcactctccctctcccaagcaaacagattttctcttctgtgttgtggggccactgctggggaatggaggagcggtggtctcagtgattcaagactgtttttcctacctcttcagtgcatctttcagcaatatgaagtttaaaccaaatactgtgagtgctcacctgatttttggttcttacaaaagtgagttttatgtgtagcagtgtccttgccaaggggacaatcagtggagccttctattctgccatcttgctctgccaccatctcctatatttaagctatatttt

SEQ ID NO: 637 - DNA, 50130 bp, Homo sapiens
ccccagatttaacaggaaagcccaactattcaaaagttaaacaacaaaaagtgaagaacattgcttttttaaaaattccaaatttaaaaaaatgtagtagaagacacaaagcataaaatttgccattttacagtggccagttcatggcattaactacatttacagtgtgtgcagccatcaccagcgtgcatctccagaactttctcatcctcccaaactgaaactctgtccccattacacacgaactccccatccccttccccagcccccgacacccaccatcctactttctgtctctatgaatgtgacggatgtgactactctaggaacctcacttgagcggaatcatacagttcaaaggaagagaatgttgtatttggccactcctggcatctgtccatctgcttcccgatgggtcccaggctggatacctccatgtggggtggacgcagcgacaggaactgagggggcccccggccaagggcaggaccagcagccctcccgcatggcagctcccgcctgctgcaaatgcaagagggaggttgatcttggaagaacacacctttccaacatgcattcccagagacaatgcagatctcagcaaagtcaggggtgaggacagtgctgaaatccatctccagacctgcttgctaaaccccacagtgtcactgagtcccactttgctgtgctcatttcattgattccttcctttatgcattcagcaaacaacagcccatgccttttgccaagaccgacacctgtgcctcagacaaacacgtggagaagaaggtgactgcctttaagatgaccccagcctggcagggactatgaacaagcaggaaattcatcaaaagatctcgtcaaaggctgggcatggtggctcatggctgtaatgccagcactttgggaggctgaagcgggcagatcacctgagttcaggagttcgagacgagcctggccaacatggtgaaacccagtctttactaaaactacaaaaattagctgggcacctataatcccagctatcttaggaggctgaggcaggagaatcgcttgaacctgggaggcggagattgcagtgggccgagatcacgccactgcactccagcctgagcaacagtgagattctgtctcaaaacaaaaacaaaaacaaaaataaaaaacacatcaagaatgctttgaagaagcacacaaggtacacacaagcttcatcctgctcaatgccagaatcccggtgttgctggtcggaggcaggggctgtctaggggggctataggctggggatagggctggacatggggctgctgggcacacagcctgttctccaggaacaacaacaacaacaaaaacaaaaaacaaaaaactgaacaacaaatcagtccactgtaatcagaaggctcatcgaaaaacactctggaaaaattaactgacaacaaaaaatgtcttcccggaaaagatgaggctgggcccaatacaggaattaaaaccaatcactgctgaccccacacgggtgctgccgaggttcagctgctatatttacaacaagagaatgatgcatatgtcacgaattggaggcaacgccacctgccacaggccctcagggctgagtcccctcaaattcagtggccgacacctcacagtttcgcttcagtccagcagcagactggggagctggggcaaggcagagtgccctgggctttgagtccagcatcggggtggccaggacccccgagaaccctctgaccccctgccctgccacagcagggcatacagtgttcaagaactctggagccggagccagacttgggtttgaatcctgccctgtcactccctcatcatcacctgtgatgggtcatcctatgttcaccaaacctcagctgttccatgtgcaaactgacactaatgccatctccttcctcacactgctgagcgtggaaggggaccctggcatacagtaagtgctcaagaagtggcagaggtcattattgaaacagtccttgttattgttcccagagctgtgtggacccccagaactcgcatgctggtagcctgtggcggcaagggcagcgtttggatctcctgtgcttggtgccccctcaaacccaggacattcagtgtaaatgactgtgagcctcaggctggaaagatcgtttcccttcccagctagaaagactcatccatcaggctgtgtcagacgcacctgagccctccagggtggtcaaaggtaaggaagcttgtgtcccaagtgcagcatttagggcttcccaaggcaaagtgcccaatcaggctctctactctccaagttcgtggtgcatggtagccacagctcacctctcccaatacacaggatctccaagggccaccctgccatccctcaagttcctcagcccatgttttccctccttccttcagtttgacaataggggtggagcaaccactttgcaggatgtctctgcttaggggctatggagaagcatgggacctgaactctgcactctttgggaagaaggatcagataggattcaaatctgtttcaccaaccactaggctccaggcttgagcctaacaagcagttgctcaaaataacttggtagatgtgtgtaacccagatagataccctaaccccacgtggtccagtccttgttggaaagattttcaaggaatcacagtccagataccaaacagatagaaaacagggtttctgatctttaatagtacttctccagttattaaaaggaatctaacttttatttattttatttatttatttatttatttatttatttatttatttatttatttttgagacagagtattgctctgttgcccaggctggagtgcagtggcacaatctcggctcactgcaacctctgcttcctgggttcaagcggttctccctgcctcagcctcccgagtagctggtactacaggtgtccgccaccatgcccagcaaatttttgtattttttttagtagagataggggtttcaccacgttggccaggctggtcttgaactcttgacctcaggggatctgcctgccttggcctcccaaagtgctgggattacaggtatgagccaccgcgcccagccaaaagaaatctaacttaaagcacaaagcaatatcttttggtagccccaacttttatcatctgtatgtagaagtaagcccccagttttccttcaagtcttgcctgtgcataacttttgttccttccggctttctgcctaagctccctctgtttctttgttttcctctttcctctagaatctgcatcacagaagatatccagttgggcaagaccccgcctccctgacaggtggcacaggagggtggttggagcaggagggtgggaagtgatacgtggatcttggaagaacagcctggctctaccactcgccgtgtgtctgtgggtatgtgagtccccactctgtgctgtggcctcctcatgcagagaaaggagctgataaaagtcaccgagttaaacttaacacaaagtgagttcatgtgtgtgaactctctcaaaaacggtgctggcacacagtaggtgctcaagcagcgcaagcattttacacagtcactgccgtggctgttcggagtcttatttgcagtctgtatcatgctgctcagcagttaagcttttgttggatctgagctctgtcttaacaaaaggggacaggacccccttccctctgcggtccttctgcccaggcatgtgacgaaggtggtgaactcagcactcactgaacacccgcccatcccaccccggatggggactctggggtgtgcatcagcagtttcaagaaacacagaatgaccacctgacccagcaattccactcctaggtatgtaccctaaggaactgaaaacgaaaactggtacaaaaacgtttatgtcgacattattcacaaccataagttagaaacagcccaagtgtccctgaactagtgaatggataaactaattgtggtctaaccacatggtggaacgttattcacccacaaacagaaggtagtacggacacatgctaccatacggatgaacctaaagcacacgatgctgaaagaagccagacaaaaggttgcctagagcatgattctgtgggtggaaaatgcccggaacaggcagacccaagacccagaggggatgagtatttgcctggggctgggagggagatggagagtgagtgctaatgggtttgatggtaaattttatggtctgtgtattttaccacaataaaaaagacatacccaagtgaaaaaaaaagtgtataaacacatgacaaaatgtattactaacagacacatataaagaagtaaaattccacaaagataagccttgttatgcggacactgtctcctggtggcagcatccctggttttttctttggcttctctgcattaccaattttatttgtgtctgacatgatttactcgaaacacagtgaaataatgctaatgtaaaagctggctatcaggcagatatgggggtaaagtttactcaaaatttcctaggaccaggggtacaattccccctgtaaacccctcaggattccagtgggcctggggagagaaggctggcaccttccagggaagggctggcttctcacgctctctctgatgtaaatgaatccacccctccacctccatcagcttttcaagttcaggccctgatggagagggggaaggggtttgggaggaaggagacccttgtccaagacggaagttctatcctggctgtgctctcctcagtggtgccttcctttccttaaggaatatttattggtggcctgccatgtgctcggctctgggtggtcccttatctgatggggcatgtgcaggaagtgactatggcagagggttatgagcgggcatcacaggcaactttcagggagcagatgcaggaggtgccctggtaaagcaggtggaggaggcaaaactgtgggcaagtgtctggggacaggaggggtgtggcacattccggagaccagagagagtgtccaatggcgacgttcatctcctcactggcctggcacacgtgccatctccccttctcacccatataacccactcctccatctgcaaccccagccctgagggtgctgaaggaggtgcacatgcccaggaccgtccctgtctatctccatgaccccctaggtcctgccatggagactgaacacaaaggagatgcatgggaaagtctgctccatgggacccatctgaagatcctggggagagggaagtagagaacttgctggtgggtggttgatttcatgagaccacagcggggctaccattctcagggctccacagcatcagctctaactccccttctcatcccactctgcttactgttggcgcacacacaccctaattcccagggctgacaaactccatcaattaaaagatcctgtggggcacttagcacagggccttcctccagttcatttgccagtctaaccacttgtatcatgaaactccccacgaaagggcaccaaaggcgaagagaaatcagtactaacaagagcctgctgagaacactgggaggtgggcagtgggtgtatgggagggaggaggggggcaggtggagaggacccagaggcaccaatgggtgcatcagaggacctggcgccagcagcttccaacatggagatgtcagcccactatgcctcctgcagccttcgctccatgtagcctggggctgggtgtacagcatccacacacagaaaaagatggctgttaagattacatcccaatgatctgggacttacctggagcatcagacagacacagtgcaaaagaaacaagctttggagtcagcttagattcagacctccctggagggccctgggcaggcttcttaatctctctgaactgtgctgcatgctggagatgtagcagagacctggtcagcaaactctctgacccacagggaatgttccctgagggaggtggatagtaagtcagtcacctaacacgggagatgtatgattcctatggtcatggaagcacacggtgtgagtgtgagagtcagggcaacctgagggtgccaagaggggcctctctgagaaggcatcatgtgagctgaaacctcagtggtgaggggagtggggctcaaagcagatgcagatggacatggcaggacatagcagatgctcaaccatgttggctccttggcccctccttgtggaagagatttctccatcgagtagatgagactgtcactaagtaatgagcctctatgcccagaaactccaaggacacaggggacagaaatgaaaggtgcagggatggagggaggggacatgctgagggctttctccagactcctgaggaaggctgcatccaatcctcccagctgtctagttcagcaccctgcagagagccagtgccctggagtggttcagcaccctggagagagaccatgccacacaagggttcagcaccctggagagatccagcaatgctcttgctctgtgcagctgtacagccacacacatttgtacctacttcactaacaacccaggcccccactagaccagccggtcatgcccagcttcatagcatctgatcactccccaaatccaccttgaacattcctgaccccctaagcttttgctcaagaccttcctcctcagttctgcctgcaaaaacctcacttacccatcaaagcctggagccaacaccatctttcatgaagcccttttcctgatttactttggggccttcaccacactctgctttttgcctaccccttctagactgtgtgttcctcaaggaactgtgtctgattcacgtctttcttccagcccagtacctgggaggcagaatgtatgcttcagaaatgaatgagtgaagcttcagaagtaatttttacaattgccaccatttgttgagaactcatgatgccagaaactgctacatgcttcacacacacttttatttacagttcaagaaactgaggccaagaaatgagcaacctgcccaagttcacacagttaggaagaggcagagcctggattcaaacctggatcatatggcacagcctgtgcccttgaccgcggctcctctctgcctctctccaaccctgtgtgctgccatctgccagtcccatggcatctgagcacagcagccatggtcccctgaagtgattctgaatctttttatagcctgaaattgaaatcactgatgcttcaaattagaaccccaaaatgaacgagccaagacttcagatttgcagttgccgagctgcccgcatccaccttctcagcaagattcctgggccactcctcagcccgaaccacctgttcccagtcaatatggaggacaaagagaacgacctccccaggcccagaaggccacatgcagaaaagggatccaacctccccgccatccagggctccccacagagcagtggcctctgtctgggagaagaaagaccacagtgcattaagcctcagagagcagaccccaatgctgttggcctcagagactgaagatccccagtgctattagccttagagagtaaaggcccccaatgctattacccttggtcaatggatcctgacgacacggtgagaagccactgagctgccaggacagaaacaccccacactcaagagggatgcaggacagaccctgtttgtctttggtgtgaatgcaatgaaatattggccttgatgaccaaagcaccaatgtgaccctggctgaagaattcagcagtcaccctgggttcctgctaacatcagctggtgtttggtctttaacttggttattaagtagccattcaaaaccatctaaataagagtggaagaaattttggggatggggtggagagttcctagattggtcatcaggtccaccagcaggacatgtgacaaagtctctcacaataccccaaaaggaaagctagagaaatgtgagctgtgtgatgtggctgaaccactaaacccaagggatgctggcaccaggcaaaccacaacagggctctggccttggccctgggatttgctgctagagggcaaagtgggcatcaggaataggaattccaaggtgatctaaaagccagacccatgccaacagagaattgtacaggctggtaagtgctctgggagcagtggtttgagccaaaggaggagatatgcctgccagggactttggaggctggcgggtggggtgggacaggtacctctattagtgatgttcctcacaacagaggcacaaggaaaccatggctcatgtactcttggctggaagtgtccgacgtacttggcacatggtgggtgtgccctgtgactgctacatgcttcaaataatagtggtaacaaacatcagtcattattataatattattatccccgtttgttcaactaatagccactggtttcctcttctgagtcaggcatcattaatgatgatgaaagacaagatgataatcaatgacaaatactgactgaggccgggtggggtgcatgcatctttagtcccagtacttcaggaggctgaggtgggaggatcatttgaggccaggagtttgagaccagcccaggcaacaaagcaagactctggctctataaaaaagtacaaaagttagctacgtatggtggtgcgtgcctgtagtctgaactacttggaaggctgaggtgggaggatcttttgaacccaggagctcaaggctgcagtgagctgtgattgtgccatgcactccagcctgggcaacagagcaagatcctgtctctaaaaaagaaagttgattgaatgccagccctgtgctcagcgcctctgaccagcagtccagtgctaagagcccagttcagcacaaccacccattttatcaacacgaatactgggacccagcaagcataatgactgatcatgctgcatctggacttcattttctttcccttttctctttttttgagatggagtctcgctctgtcacccaggctggagtgcagtggagcaatctcggctcactgcaagctccgcctcccaggttcacaccattctcctgccccagcctcccgagtagctgggactacaggcgcccaccaccacacccggctaatttttttgtatttttagtagagacggggtttcaccatgttagccaggatggtctcgatttcctgacctcgtgatccgcctgccttggcctcccaaagtgctgggattacaggcgtgagccactgcacccggcctggacttcattttctttcctccaagtaatatttaactctgaagctgtggggattgacccttgagcagcgagctctaacaactgttcttcacaccagcttggttgcaaagtcaaacatgctagaggccacctcacatttctcaagtcccattttaaaataccagcccaagaaacatatatatttttttcaagacagagtcttgctctgttgcccaggctggagtgcagtggtgcgatctcggctcactgcaacctcccgctcccgggttcaagtgattctcctgcctcagccttccaaaaaaaaaaaaaaaaaaaaaagaaagaaaatgaagtccatattcagcatgatcagtcattaggcttgctgggtcccagtattcctgttgataaattgggtggttgtgacagtagcagaatcacctgagatgaactgggctctcagcactggactgctagtcagaggcgctgagcacagagctggcattcaatcaactgggattaacaggcacatgccaccatgcccagctaatttttgtatttttagtagagacagggtttcaccatgttggccatgctggtctcgaactcctgacctcaagtgatctgcctgccttggcctcccaaagtgctggaattacaggcataagccaccacacccggccttatgagatactcccagggtctccgaggaaaacaccagggcatccctcttagcatcctgacttaaatacaaaccacgagtataaagaagatccacgccctctctcgtgcaagtatttaatacgaggaaaatgtaattagcaaactcgagcaccacttttcaaggatgaaggatactgccacctgctttaactgcaagggaaaacctatttgcagaaattaacacaaaaatgagattggccacttcagggccaagaaaacaatcacaaaaaccataggcgtcatcagagccctgcagcaggcgggtaaggaatggccccgggaaattaattaatgcccaggaaggctttttcctctgacagcaaacagcactatctgtgccaagggggctgaacatttgtctcctctgtgagataactttcttctaagacacagtttcctatgtatgaaatggatacttttcaaaatatgaatacttcgattctaggaaatctgagacaaacatctgaaagaaagagaaaataacacaatctcaccacctaggggttaatatttcctttcctttttgttttctattctatgactatactggggaaagatggtattagatgatattgtgctgatcattttgattctgcctttctcactaagtagaatgtaaccttttctggttggtattaagagctccttgtaaacatcatttttaatgctttcttatgaattcacaacagatgtccattgccactgaaccattctcctattagccccgccccctccctgccccaactccttgtttttgccacactgtaattgctacctggttttgtttttgttttttttgtttttttttttttgagacggagttttgctctgtcacccaggctggagtgcagtggcgtgatctcggctcacggcaacgtccgcctcccgggttcaagcgattctcctgcctcagcctcctgagtagctgggatttcagacacgcaccaccacgcccagctaattttttgtatttttagtagagacggggtttcatcatattggccaggctggtctcgaactcctgacctcaggtgatccacccgtcttggcctcccaaagtgctgggattacaggcgtgatttctacctgttttttaaaaaattattcccttagcatggattcctagatgtaaaattcctggttcagctttatggctcttgttacatactaccacattgattgtgaaaacatttatggcaacttaggctttcccccagcaacacatgagtgctgtcaccagcaaggagtatagtcacaaaaaagtatttgctaatttgaaaataaaacagtcaccgcactgcttttctttttaccttttgcccatttatacataaagcacatcaaagtgttgttcaggcatctttgagccatgacattacagagtcagacaatgtgggttggaattccaccttctccactcaccagctacatggccatgtagttactgcacctatgtacctcagtttccccatctgtaaaatggggaggaacacacatgctatatggatgactgtgagggttaagcggagcactgcagggcttgtagggtttggagatccagctcagctgctataaacaaggacacagccttcttgggacatttgttgcaaatgttgtttgccctctgcctgcctgctgttgagttgaactgtaaggatgtctcagttacaggatattttagatcacaaaagtcattcaagaaacaacatttaggttgtcaaacaaggggtttgtggaagacagtcctagtcttaagactaggagattaacgcagcacctgcttgtgtttgggtcgaggagactttagttggcaggccacatcaagaggctggaatgtcaacttgcactgggccagtgggtcatcaccttgcctgcctgttgggacccccggcatcaccactgcagctttcatggatgcccagctctcgcctcatgattctgattcagggcgtgtgggctggagacgaggtttctataaccctcaggtgactgacgcccagccaggtttcactgagtgagacctacagtgagccctgcatgacatccaagtggcgtccccacctccacatctccttacacacttgatgcactaccgtcatccaggaaccacccacatcctccttagcacatgtcgtgaacttcagaagcaacctgtgatctctccagccccatgttgtgggagtgaaggggcctaataagggccatctcaaagagacagcagacaaagtcttcagcaaactcttatggcaggctcactctcctttgaaactctctggtctcagcttcctgacaagctctaatcattatgaaaaccagtttggactgggtttcctgttgtcaccagagggacatgggcctctgtcactcctggctggtggaggccccatcctcacctctgacctgcatagaaagaaacacctgccctgcttctctcgggggctgtcactgctccaagcctcggcttcagcctccctcagcaggtcccacgggcattctccgcaggggcattcaacttcccgccgccctgcccctcccacggcctctgaaatctctttggctccttctcccctgggctggctgacatttcacaatctgggacggcttagtgtcactgtctatcctgggaattccggcacactagctgatctgaaatggcaaatcgcaccatccatggggccactgtgatcaaatgtccctacccgtgggacattcacttatctttcacgtccacctctgaggtgaaccttttattaccacacagcttgagtgataacatctatctgtctcatgagactcccgatctggagatagctcaaagcctttgattgtggttggtagggtcagggggtggtcaaccaaggaacaaaaacaacagcaaaagaacaaactcttcccaaaagcttaggtaggagagaaataaattctacaagctaagtacccaagaaagtcatgcacagcaggaaatcatgacaggcaccaaggccgagagccggatggccacgtcggggcattctcacaaagttaacgagggaaaatgaagttctagagataccaaagacattaaaagccaacattcacttcaaagggtgcccattggtccaaaagttcaaaccgcagcatgcatttttaaagagaaaataaaaatctgtcacactttcgaggttctttcaaaatagcagagagaaaggaaggcttgccaagggctgcttggggtaaggaagacagaatgcctgcattttgggcagcttttcacgtggagaccttgcacctcaccgggagctcagaaaccccactgactccaggactggctgctcaccaaaaagaaaattcacgtgagacatgtgaggctatttcacaccatccctccaaggtcaaagctcttcactaaaaatagagaaacatggtctgttggaacaaacacgcacctattatgctatacaagattttaatattccggtggcaaaatccagtcgctaggaacacaactcaatggaattctcagtcttaagcccctagaggagaatttctgagtcccagaggcagctgtggacatgaactgggaggagccaggatcgtgcaagggtccagctgcctgcaccccgcaccctcattagtgtatgactggtgtggagcagcctcgtagggctgtggagggcccagtgctccttgggttatctgtgataatcataatgcaggcgcagccctaatgcatctcaggaccagccattcctagaatactggaagtcagaggttacccagaatataaaacctgccccaaaatggcaaatctatttgcataccagaggttaaaagcaatgtcagaggaggtgcttagaaacagaagtgtggaaactctcaaagctccaaatttccacaaaggcttcaaaccgacaggacaggtccaccttctcagccccacccaggtgagcgctgcagccacagacagctacatcttctaacccactgaggctccgctcactgggcaagtgcagggcccacacacgtgcctcagcaggccacgtttctcttattgatgaggttatccaggaaacagtccaatgagctgaacaacgggggttgttcttgcatctgcagccctcttttattattgaaaatcaagaaccaagagtgacctatttcaacaccccccccaccctgcctgtcacacgtgcacacactcttacaccacctatagacttcagccctgctgctaggcccaaggccacgcccccccaacacacacacacacacacacacacacacacacacacagacacacacacacacacagacacacacacacacacagacacacacacacacacacacacacagacacacacacacgaaggggactcacatcccaactgcatcctacagaggatgattcaacccaggccctctgcatttccatgaaggttacaaatcgagttagcccacaaagccacagcgggctccaatctctgtcattctggtggtgcacccgacagtttcaacacacaagaacccaaataagctcatttctcattcaaaccaggttctgattggtcaataataatttaaatgcatcttccagcaaatcaaagagatcaacatgaggcactcagaataagtttaagcacctgctccatcttacctggctctccaatagtctcttcccttctgactttccattgccccgtaatagtcctgaggatctctaaggagatcactagcagaatcatagcatgaacaagaagcttgggagcttaggcctgattgggagaaatgatcacgggtagccctctcaccacgggtggagatgtgggctcctcatttacagaatgaatgtctgtctgtccagcccaatggcagggaccaccaaatggctggctggatgccacgtacccaccccttccacctgcatgtggagttctgatgtacacgaggctgggctcagggtgacatggaagagcgcgtgcatccaagaaatgcgcactcccaacgaggaccattcgagtctactgaacctttaaaatatcatctttttcaacctgtaacattcttttcttcttcctacttccaaagagtcacatgttcctttgcataacaagattaaaactgaacacctaaactcacaaaaaggcgaggtgatcagatgtactggggcctccgaacccctcgcacacaccaacgtgccaaccgtagggactgtttgcagagccggagcactcaaacctctattctctaaaggaagagaatgctctttccttttcagtaccagcaaaagttcattttcaaagcatctgaattcctaagtttcctttttgcaccatcgacaccagccatccctcttgcccgggctccttggtcttggaaggccatcgtccatctgatggggtggttaccacaacctgcaaatctacaagctcttagccatcaatgttacagacctcacgccagcaactgccacacaagagtggttgccgactcacccataggacacaagaagggacgatgactcctcttggtgcctatttagtcacaactaaaccacccacaggtctgcacatgtccccaacatcatggtgaccacatgcctcctctttctaccttctacttcaagaccaatgaccaaattccacagacttttcctccttccaacgggttacggccaaggcctccaagacaagcccaacaccaggtccacaggcagtggcacccacggtgggagaaactgaccaatgaaagttcatggcagcctccacaagcacccccagactgggcctcgtggctgtgctgccaggactacgaccctctccccgagagtcggcgctctccccaagcagaaagatacagacacctgtgtccctacctcaatcaagaagtccccggtccttagtccggcttgccacgccaccccaccttcatccacggactccaggtactgtagggctgggaaagccggtgttggtgtgaattcttcaatgggtgtgtcagctgggaagacaagcagcacctggttacaagcctgggagatgtcttccaagttcacattgcctgacctccccacaggaccccgggaggaagtgggcccactcatctcccattgcaggtggctagtccaggccaactctcccccaggaagggcttgagattcatactcatgggctgatgcaactcaagcaatgaagtcaattgcaccttggggccgccatcatatttcttggcctctctgctgaaaccacaggataatgtgctctgtggtacatgtctacacgcctgtcattttctttaaaagcatcagtgactaaacattttcggttctaaaaatggaaaagttcctcccctgccacacagagctacagaaacaccacactaaaccacttgccaaatttacatctacgtagactcgcaaccaagggaattcaacttggaacgcggacggaacatcacgctgacccagtgggtggctacagatttggaatgtgctcatgagtcctctctacagggagtccaggcctctgtgaccactctgtgtgtgaccagtgtccctgggcactggcatgtgtgtgtgtgggtgctgaaccactactgcccagcacagtgaggcttggcttctggggccccacacagctgccaggtgcaactccagggcaggagatggacttttctagggaggcatgagtggccaagggtgggtgggtgtggagataaagattccagcagggggaggggagagcaaatcacacagacaggcgtggatgctctcacagagacagatgcatctgctctttctctctctggacagctcgctatggagctgcctgagtctgaggcaggtgggcatgccagctggggaggaggcctcctgcagcacaggtgcgggacccctggcacagcgcgtaagctccaagatgaaacttccacatggctgagccacacacacagtgggcggatgtcccctctcatggggaggtgatgccattttgttttcttttggaggggaagctgcgcgtgcagggtgactggcaggtgcaccgccatggactgcattcctgagcctcccacgacgggccacgtaacgtgtgtgctgccggctcagtccacggcagaggggaccatcttgtcacatttcctttgcaaagtcaccttagaggtgagcacacaaatgcctgccgcccttggagccaaagcccactcccagaatggggcagtttctaggtgcctgaaactcaggccagggcaatcctggggatttgagacccagagctctgagggtagccacagtctggctcaactagaacacaaaatactgaccaccccatcatttaaaaacaaaaggtaggaggggcaggagggagagagaacccattcagaacaacatcatctacagaaaattaaaaacattcctcaaggaagccctaacgttttctgagtaaggcacaatgtgaaggaacatggttgtctagcaactgagtgcccccaggaaaaatgcttatttaatgcttattcctgagctggggaacgtttttcatgcaggcgtatacacacacacacacacacacacacacacacacacacacacacacacacacacacaaacatgggaacatattcaggctcagagcggctgctcttacctttggcccctcgaagcacgaatccaaagccctcattgtcttttttctgcaggaccaccgtcttctcctcaataatgcagtcactgtagagagaattccggggacagcgaccattattgtagcccgtcatcatcaccgcggccgctcctccgccggggacgttcatcatcatagccaattaatcaccccagctcgccagatccaggcagcatggaggaaaggaggcagcgagggtgcaggaggagcgaaggaagaggggggtggctaccgggataggcgagcgtggcacaatgagacttgcagggtgggggcaggcagagccggagccagccggaggaaggagtcatacatggtggggcggctgcctgagggatggctgagctggaggctcaaggggggctggccaggacgccgcccagggcaaagaaagtaagtggcccgaacggcggcggcggcagcggcggcctcagcagcggcggcgtcgggaatgagctcctccggcttgtcccgaccacacgcatcttccagggaagcccgggaaaatcagccagaggagaaatgaggcagcagttttgttttgcttttccttgaagggggtttaaaataaaatcaaatcctatctgctccccgcacgagccggcagcaggcaccagagacgcagggacctgcgcgtcgcatccagcgccccctccctctcccgtcccggcgccggcggtgtgcggcaggcaggagcccccacaatcatctgacgagcccacagtgcgcccggcggctgcctgggcgtcatcccgcgcgagcatccgcaggctgggctgggagagggcggggagggggagcggctggggctctctctgcatccccccctccagcgtccccccggtcccttgcagccttggaaggtggccggtggccggtcggggaggggtgggggctccctggcagaggactcaggacatttcggtgttaaagcccctgaggacaccagccccctctggggatgatgaattcattgctggggaactggagggggtatgtggctgcccctttgagatgacaaagctaaagccacaactgcttgcctctagccatggcattttttttttttaaggaaagaaaccaaaaaagctccaactttgctctagtggccacagtgtcctctcgcttttcctgctggcactcgccacatgacatccagcccccgaggcacccagagtgtgtgggacggtgccctgctcagtgagcctccaggctgcggctgaactgtcctccacccccaccttctgggtggcctgcgggggcagaaggggagtgagatgaaggctaccggcacccccccgccccgtaggactctgctgctgcccggaagttagtggggagctgggaaggcctctgtggaggggagcggggaagggagggaggcagcgtggagggaggcctctacagggtcttgcggggctgtgtgtgagcctcgggggtgaggagaaaggacaccaggccagcggcccagccggaaaaagctgcagatgggtcatgaggaacccaccaggcccccgtcgcacaggggcagtcccagggatgcaaatttcaaacaaggccatgtgctgacggactcttggtcccagaggagtgcgggtcagctctgcctggcaccagcaccaggttcacggtctacaggaagcacagggccccaggtgcagccagctggtgacagcacagccaccccggattggggggccctggggaggaggagggacggggcaaacgtggatgacagggctcagtatcctggacaagggacgagcagcggcccctcgatcctcccattttacagatgaggctggtgaggctcagagagatcggaggacccagctagggaacgcgtgctcttctcaccactccacgcacccacccccgacagcatcagagggtcgtgcatggaggcatgctggggtgaccctgtcttccaggaatagcccagcatgaatgatagcttcacagccgaagaccaggacaatccaggtgactggtcactcccgttgtcagcagctgggaggggggttctggcccctgaccttccttaccttgccccctccccagagacagcctgctaagtgcagggaggtccactctggggaactcggtcacaactgtgagcccctcttggctcatccctggaagcccacttaccctgctcagggccaccaaacaagggctgacacagggtcagaggtccaggaccctgggagcctgggggtgaggtcacatggttattgtgacctttagaaaatgatggggctctctaaacctcagtttccctgcacagcaagagtgggtaagaacaaacctacaggcctcttgggatcaccatggggtcagatgaggccatgccatgctggtgtggtgtaataggatgcctcaggccgctgtccctgtgacggctgccattaacctccagcaggcctggtaggtggccaggactctgcagccctaaggaggctgagcagggagagctggggctctactgccatggatttaggggtccatgaggcattgatgagcagaccctctaccaggtccctcgacctgtctccacggccccccacaacgagaacacagacttgtgtccctcatgggaaatgccttctagtcaccacccattttccctctgaactcctgaaaggggagtcagcccaccccggccccatggctcactcacggctggggaggcgcaagctgtgtgaccagcctgtgtgtctcctgtgtctccttcatggaaggttctctaaaggccaaggctgccaaagccaagagcctctgctcaaccctgctgtgcacctgctgtctgcaagaggagctgctgagggtgaccgcctccctgaaaccctggaaggatgatgccgaaccctggggtctggagctcagggccctgcactctccctggggacacatgggctgatcaagtccatctccacccagctccaaggggaacctgtcatgcgctccaggcgtgctcacttgcactgctgggcagctcctcctgcagtgcccaacgccatccaaaccttgcatctccaagatgacccagaccacttcctgccagcataccctgcgacgggaacttcttagggccaggggggctgcccagacacttgctagctgtctcccatagactagagaagggcaggggcattccagtgtggctggtggaggcacaggctttggcatcacacggagcgtggttcaaatcccagctttgctttgaccccaaggtcactgacctatcaggccccagagcctgctctgcaaaatgagaacaacaagatgcacctgatgggtcctgagctggaggccgtggagtcgtgcatccatgcctcagaaccagcccaggcaagcagcacatgttcataactccaacagttacaagtgggatccctgtctgcacacgccaccctctcttccccggacccccttcctcctacagggacccctctgatctcgacatccagggctaaaaccttttcagtgattcctaatgcacccaagaacttagttttttaaaattagagacggggttttgctctgccactcaggctggagtgcagtggtgccatcacagctcactgtaagtttgaaccccaggcagtacgtgatcctcctacctcagcctcccaagtagctgggactacaggcacacaccaccatgcccagctaatttttaatttttttgtagagacagggtctcactgtgttgcccatgatggtcttaaactcctggcctcaagggatgctcccttctcagcctccaaggtgctgggattatagacgtgagccaccacaccctgctccatctgagaattttctagcccacacttgtaactgtgcaaagatcttgccccaagactgtaatggccctgtcctgtttattcagtaaaacaccaaactgcttagtctctgacattaagaaggactgtttctaacttctctttccggcattgtttcaggatctaaacagcccccactccccacccaccatgaacccatctcactttcactggcagacagacatgggtttgaatttcaacccagacattgaccaccttgactacttacagcctcaatttcctgacctgcaaagttggggagaaacctctggcttgtaagttttaggaggagcaagtgaggcgatgcccagtgaatgctccatgagcaggaggctccttgtaaccaggggaagctgctcttcttagcatccccgtccaccttcttgagctgggtgaccctggagaaaatgtcccctctgagcttgtctcttgtgggggaggggacattttctacaaggtcaatgggggcagtgacctcatcctgcagaccaccccaaatgcccacagcaccccgcataggccaggtgccccatgtgtgcccagaggggatgcaaaatgggtatgaactcaagtcaggagcagagcagggagaaacggatgttgggtgggaggtgggcgaaggatgactacagggtttcgagtaaaaaggcaccagaacaatccctggattcctagttaaacccagaaggtagactcagtgctgcagaggacctacggcatgcacctggcttggcccaggaagtcagagaggaaacagaaaaggcagccccaggcccttagaaactttcaatgttttggggaattcatgaaaagcaatgggacactctagaagagacattccttgaaaggagctgcagtcactgtgtctgaaaggcggaacttggcagcaccccccatccccatgcaatcagacaggggggtctcacacgcaggccttaggaaggggcctttctggagacaagaaaccctcagaggctccttctgctggttcatgaatctaaaacctatcccaggatgacagctgcggctgggtccggaagttgtggcattgagttctgtgtgctgccctagaactgtgctgaagtccctgtgaaccagagtctgccctgaccttggcccctgccagcctgccctgcccctgcaccagcagacccactctccacatgcagatgagatgcactgcaatccagtttcatggggaaatgaccgaggcgcctacacgttccccacgctgtgttgggacagccttctccaagcccgtctcaccccctaacctgctcactgatcacgtgcctgaagtaggcactgtgggctccttgtaagcaaatgccatgccctgatcctctgagtatctccatgcaacacaacattgacccgtgcttattgattgaacaaaaaatgtaatccagcggcgcactccccaaatgttttctgagctaggtggaagggcactttgacatgccccaaatgtaccctcttttgccaacatctgcttgcagcaggagctgtggaaggtgaagggggtgggcaaccagccccaccaagtacagctgtgcaggttgtgcactgtacaactatggaggaaaccattgccatcatggccatcacggcacaggtactaatggtaatttcgtcacagagggaagaaaaacgtcttaaggaaggggcaagcaccttttcctagttcaaacaaagatggggtctaggctgccctggccatgctgccatggagaatgcaagaggtatccctatgggagccatattggcttcccggagacacaactacctccatgttgatgccctcctgggagccacttggaggagagagcatcaaaggtttgcctgtttctgctcacccacggtcccactgtatgctgcaagagagcttatgggatacacttggagcacttagcaccttgaagcaagacaggagggttgtggagacccagggatggccacgcagcaggccccagaggtctctccccgctggcaggcctaaagatgctcctggtgtctgcctcgcaagaccacaggtggccacacaccctgtggcttttagcagtggcccgggttccctttctcccactgggcgccatgacagactcacagggaaggctgcactttccctggtccagcgggcagcaggtgccagtgatgacagttggcgtttaggatctgtcagtcactttaacaagctcccttggcagcagcacctgatcctcgaggtgatgtccatttggaggcacaggaagccaggcctgagctggcccagacgtatgggcctgaggggctctgggtggctctgtgtgcctccccacacatggggtggatagatgtggacattttaactctgaacaccagtgttattggggtagaccagatggctttactcatagctctcaggatcccagctgggttggtggccccgtctggtgacagctttagttcttccgtgaccagctgggactgggtttcaaagttcagaagtaactggggccagtgtcaagccgccgtgtaaatcaataaatcaatccagctgttacatcctgaatacccactgagagtcaggggatgaactgggtgctgggcatttaggaaggaacaaaccaggcccagtctggtccttatagagttgtctggtgtggtcagttgaatggtgactcaacccacccaaaaaaatgtgtccaattcctaacccccagcgtctgtgaaagtgacgacacttggaatttgggtctttgcaggtataattagttaagggtcttgagttgagatcttcctggatttagggagggtcctaaaccaatgactgtgcccttacgcgagaaaagcagagggaggttgacacccagaggcagtgcagaggaggccatgggaaggtggaggcagaggctggagtgatgtggaggctggagtgatgtggcccagctgaggagcaccaaggactgcaggccaacagcagaggtggaggaggaagactctcccctggagcccccggagggagcgtggccctgctgtcatcttggttttggacctctggcctccagggctgtgacaggtaagtgacttctcttgttttgagccccctagtctgtggtgatcgttagagcaaaggccgggcaagtgaggaagataaacatcaatccacagtcacagaaatgtgtgccttcaacagtgcaggacgtggttctgtgagaaccatacgggcacctggaagacttcctggaggaggaggactgaagtatacataggagaatgggttggaggactggggaggggacagaagagaaaagaacattccagacagagtggggttggaaggtaggcagccggccctgatgtctgaagggccgtgatgaggcgggagggcaggagcagctgaccacacggggctgcagacgttggctgcctactcacccagggcagtctagggacacagcttggcggtgacgcacaagtgcaggtgtcagcagggccccagccactcacgctttaccccagtttcacccatgaggactgaaatggcagaagagctgttgccctatggcttttcctggcgttctttccggtgaggcccgaatccttctggaatgactcagggtcaacttgcacctgtgccaggaacttccatccaatgatcatgcttccatctgaacaatgcacaagcacgagtcggctgctgctggctgaggaggctccctggccatcagcgtgaacactgtcgtgctcctgcctagaagccctggctgttctcttaaagcggctgtgagtggtctgtggggaacggtggatgacagagttcccacctctgcctccatgcagggtggggcttccaaggtcagagtggggctgaagcgacggtggttcctctggccggggttggacatcggatgaggcactgatgtcagaacatgtgcacgtgtgaggtccaaggtccaggccagcagaggagggggctgcacatctgagcattcggtggggggcgttgcacatcccagcactgggtgggaaggcagaactggagcagccgacccgccctggatgtgcggaaggggcctccagagccaccgggcaggaggcagcggggctgtttccacaaccaggccctacaggtccagactccagctgtctccgagggttgcagggacccccaaatgtgtctgcaacctgaaaaataaaattcactggctccaaaatccaaagagaaaacaacagtgcggttaatctctgttgaattcagtgtctctgatatttaacacggggtcaacgtcacgacccatttaagctggtatccataaacgcatcacttcattgcgtgtagaaccactcggagggcaggtgttcccaccttgcaagaatccttgggtgtgctgatggcggctggggaatcacaggagctgctggggaacgatcagtgtatcactcacggccaaacaagttcaaaggcggaatgattaaatcacttctgaatgtttttcatggcagaaaggtacattgaacatgggctgtgggtgtgatgtctgatcagacccaggcggggaccgctggaatgcaggggggtggagcaaggtccatagaggtgggtggtgggacctgggaaagccaggaaggactccccacagagagactgggtggtgcgtttattgcccctgaaagtccttcccagagcagctggagccaggagatctgccttctccaaggcagggaagggcctgagagcagcttcgctaaatcattcctggtataatcgcatttcagtggcagggcctggtgaaggcaggaactggagcactatattagaaagaggatcctccagggaacggtgatggcagtggatgtcctagaaatttccgggctctgccaatcaggaaagatgaggctaagcagagagctttcagcagttacgtggggggtgttgaggtgaggacccaacaggtgtcccagctcagcggagatgccagctcgggcgctttggccgccgggtgcgggcagccagcccagctcaccgtggcagagctggctgcagggcagcacagagggccgctcgacaggcggggcaggctgcgggagaacaggagggtttccccgtcatctgtcactcccaaggggcatgggggagcttctcagcccatgaccacacgtgcagctgctcccagcatcctgcttcctggtcggagagttacagtgtgtgatgctgctctcttgcccttcctgcataactcacaggggaaatgatgcccaacgcccagtgccatcctggtgcctgagtgacagccccggccagcctgctcctggggaggccattgctgtttccagggcaggaggtgatgactttgggcaattcctgcacggaggggactcctcctggctcccaggagccactctcacccacaggcagggggctgcgtcgcttcacgtggcatcaggagggcagtggttctgtactcatgcagcccgcacacccgtgcccagagacgtgcgctggcggaagccatttctcaaatcggcaattatgaaaacgccctgcccggcgcttattatgaccattttcctcctcattgctaacatgataagcaatgcaagtttttcctaatagaaacaataatgtacaaagaacttgattcaaattaaattgtctcattactttgtaataaatcacccacaagcatttcctgagcactaccaggcatgttacctgccaggaacggctggcggaggagacagatacggcttaactgcgctcatgatcatgacggggtgtgatcagcgctccctgccgagacgaacggaaacgtcgtctaggagggagaatgctaggagggagaatgccggccttggaagctgagcaccccggtggaaccccagcttccccaaaccagcgccacgcccctggccaagttcctcaacctcgtcgagcgccagtatcctcacttgacgactacagatgtcaaccacagcctggagaccacagtggggtgggaagctccttgtttaaaaggcccctggccaggattcagcactcagcaggggctggaaggctattagcatgtgagaatgcaccttagaacttgcttcattctggagaccttatgcataaacagatattttcacttgtccccaggtaaaagactctcctactgagatcagcagaggcctgcccttgggtgtccttccttatggagagcaagacacacgggtgtgttagccaacaaggagaaagtccccacactgtttgtgtctcagaggtgggcgggtctctgcacacagggctgtgggcagatgggatgagggcagggggcccccaagcaagggatgccaggatgcctccctgtgcttccaaagctggcacggactctgcggtgccaggcagaacacccaagtgctggcccaaacccgaggagctgtcctgaagtgagctctttccttcccccacagccaacctgtctgcaagtaccatgagtatctctattctgagcccactgaaaagtctcctctgaattcactctttatgtaaaaaccttaaatcacactgtatctcccccacttaaaacaccccaacagatccccaccatacttttcttttctttttcttttttttttttttttagagggagtcttgttctatcgcccaggctggagtgcagtggcgcgatcttggctcactgcaacctccatctcccgggttcaagcgattctcctgccccagcctcctgagtagctgggattacaggtgcccgccaccatgcctggctaatttttatatttttagtagagacagggtttcaccatgttggccaggatggtctcaaactcctgacctcaagtgatccacctgcctcggccttccaaagtgctgggattacaggcgtgagccaccgcacccagcctccccattataatcgaggataaaatccaaattctccaccatggctaagaccttttgtgatctgattcatgccccttctcctcctgactcctcccattccagccatgctgccatcctctcttcctccagcaggtcacactcatctccacacagtgcctttgcgttgcctgtgcaattctcaggacactgctccaggtctccccgagccaggctgctgtccctgcaggtcccctgggtcacctccagagatgggccttgccgcctggtggctgccgtcctcctgtgtccccagccctccagcttttctctctgctttgctttcttctggccagttactatgtttgaaattgtgatttgcttgttcactcatttgctgtctgactcccccagtagcacatgagtgcccccgaaggcaggacggttctgcccaccacactctgcagccttggatggtgccagccaccggtgttatttttggaaggaaggaaaagtgctgttctaggtggagaaggcccactttctagtcctggctctggcaagagctggcagtgggaccctggacaggaccctcaaccaccctgagcctgggttttcctgtctgcaaaatgaaagaccaggatatctgagcagaagcttcatcagtgctcctgacgcagtgaaggaagcctgagctgggacctcctatgtggtctttgatgcaggctgggtgtccccctgtcctgatgtttcctgacaaaggggttttctgggatatggggctgtcagttttaaaaccaagatggtcctggacaaatggggtgagttggtcgcccgccactgaaggtccaggcagcctgcagcgacaggtttgcccagggcacatgcctccactagcagcagggccaagtcacactgaagcctcagcctttgactctgaactgaatgttctttaaaaaaaaaaaaaaatcaggggaacagtacaactgcctggcattttgctgtgagtgcaggaagggactgttgatgacttttccttcattcgttaattaaaatgacaggccaagcctgccccatctgtctgtctcaaagctcgcccacaaagaccatgctggcgggccatgggacaggccacaggggtctccttgtgaggcaagttcccaagtccctctggtgggggtggggagtagatggccccacagctacaaaaccagaaatgtcctcctctcccgggaaccagactcagtgtgacagtcacctgatgtcctgggctttgtagggaaggctgattctagggctgggggcccacctgcagcccgtggtccccccaccaggatcacctgcccaacctggatggcacagagctgttgagtgggaggccatgagaaacccaggccaggcccatgccggaggagaaggccactgctgccgtccacccctggccaccaacctccctccactcactagggccactgaaaagtttgcttctcttccaagtgctgatgcttcattaagagactggtgtcaccagaggggcagttgtaaaaacagttaaaagtaggaggctcatataatttggctatctgtcccctccaaatcccatggtgaaatttgatcccaatgttgttggtggggcctggtgggagctgtttgggttatgggagtggattcctcatgaatggcttggttccattctcccggggctgagagagttcttactcctagttcccacaagatctgattgttaaacagagtctggcactttcctcttctctctctttcctcctctcttgccatgtgatgccagctccccttagccttccgccatgagtggaagcttcctgaagctctcaccagaagcagatgctggcaccatgcttcctgggcagcctgcagaactgtgagccaaagaaacctcttttctttatcaattacccaggctcaggcatccattactgcaatgcagctgaactaagatagaggctgacacattgtaatgggaagtattttaatgatgtccccttttttttttttgagacggagttttgctctttttacttgccagcttggcatgatcttggctcactgcaacctccaactcccaggttcaagtgattctctgacctcagcctcccaagtagctgtaattatgggagcccgccaccaggcctgtctactttttgtatttttagtacagacggggttttgccatgttggccaggctggtctcgaactcctgacctcaggtaattggcctgcctcggcctcccaaagtgttgggattagaggcgtgagccacaatgtccagccaatgatgtcctttggaaggggttctgcaaatgttctagaccaggcaacggcccagagagtgaacattccaggctttgagggtggatgggtggtccctgttgcaactactcactctgctagttgtggcacagaggcagccatgacaatatgtaaatgatgggtggggctgtgttccaataaaactttatttacaaaaacaggcaatgggccagatttggcctgtgggctgcagtttctaaagataggctctaaatattctaacgacatttaagtccacacaaataatacatgtacatggcatataactatgtataataaaaactaagaaaagtctcaatcttgctgcagaagccatgctgacattactgtgtacaggtgtgcctggcttgatgtaacacctgagctctggaaaagaggcaaggagaacgcgttttagaaatgagatcatctgtgagatgcctgagaggttcagaaggatcacatggggagtactttctggaaaacaaagaaacacctctttactttgtctaggtttttatgctctggttggctccaagtggggatagacctgaattctggcttaatgagtaataattcataattagagtaattagtgtaattattatgctacggcctttgagcaccttccacacaccaggcgttgttctaagtgttctgtgggtttaactaattgaatcctcataatgaccgtatgaggcaggagctgtgatgacgctcactttacaggggagcaaataaagcagagaggttgagtgatttgcaccagaacacagggctggaggcaaagccaggctgtctgaaccactgtgggttactgaacgatagtgatactgaagcactgttgattcctggccaggtgggggccagttccccgacagctcacagccctcccaacccagacaatgacagagagaaaggaaagaaccctcaggggaggcgttggtcctagcagcatgttctggagaaagaactggagaaggaattggtgatttactgtcctgccagtatctgagctgctgggagggcaccctgggatgctctgagaagattttgccaggagatcctgctctgtatcaaaaaatttgaaattggaaatggtggaccaaatgctgggctgggtaatgccagggaggaaggacacggtggggtgagcaaggccaaaggcaaagcaaggccccacacctaaaaatgggtgcaggaacatctggataaacgtttacagttcacaccccatgctggttatggctgtgttttatgattcccatctcaatgaactggcaatgtgtcagaagacaaggcatctcctgggcacagcaggtgtgtgctggtctgtggttcacacttttactcccacctacaacactctatacctgctatctctatcagttgaactcctattcattcttcaaagcgcactgcaatagccaccacttccaagaggaccttaatgctgtccctcacgtgacactgtgtgcttagagggaggggactaagtcttctttctccaccacacccagctcctgtcacagactctggcactcttcccagcttgctgcctgctgcagcgactggaaaagccagacacttgctattgcagcctttcctgcagttatggatggtcatgaccctatggaatagttttggccaaggagacccaaggccaagcggacccgaggtctgctgggacctctgggaaaggctggactatttggaaagggagtgggggttggggaactgctccctggcaccccctcctttacgttcctgagtaggacgtgctatggggacatcatacttggagctatggctgccatcttgccaccatgagggagaggccaagaggccttcagagatgtcactgcccgtgcaatggatgctagctgtgccctcctctggactcgccattgtggtctcagccactgtgagtgaggttttttattacttgcagccaaatgctttctaatgaacataatgtgaatatttggagcttggagtgagggggcagggtagttattaattagaagatacgggcaaaacactgggatggcttcctgacaacttaagaggtctccgagttatattctgggttgggaaacactgacccagcccttattccttcaaggactctagtcattggcaaggaggattcatgagccccagtgacacagatgggggccctgctctatattcaactgtccagagaagatctagtcacaacccctcatctcaaatgaactttggttcagaaaacagaactaaggaaaagtggtttccttggactcaaccggtctgaatttcccactaaccacaacactgacttcctgagcaagctggctaatcccacgtatacaggcaattacttgtacatcacagggctggggacaacacacaccaaggctgagaaatctctaaaaagccaagtgaagtaaagggagacagagtttaggtacagaggggaacttagcaacggagtggatcagaagatacagccaaggcccacggtctggtctggacctgatgagtggatgtctgaggccagacgctgcctctgctaatgggtccctctgctagacctgaggaccagcctgtccacagactgggcttccagacaccccagacaagccacacagttgcaaagtctttgtcattcaatgcatccagctgagcggccaacatcctcctcctggattcagcacgtggtgccgagtctcctctatcctttaagtgttcctagaacccgggccaccacccacgattctgaaaattagcctcgctcgaatgaaaccctgccttccctctgaccttccatgacaccactgatgccctgtctttgtgaccggacccttggccacagcatgggggctgaagcgtctcccaatgaggtaaaggtaaggctggttgcccctggacaaccctgctcattgcacccacccaaggaagtccaccattaatatgaccacgtccactgctgagatgacctccaagaagcgggcaggcagggaaccctcagagcaccaggtccaacacagcacgtcccaccagaagccctgttgagggctccggaagccaggctccccctgagcccgagatgcccactccctctcacactgctctgcactcgaccaccaaagccagggtccttgcgtacccatttcccagatgtgtgcaaacttctcgctgaggaagacacatcttaagaacgagctgcttgtcccagttgtaggctcgctccttctttttgcagaaggttccagccctctgttcccttccaccatctccactggcatcctcactgccatttcccatggtgtccagttcatttattttgttagggggccccctccaaagacaaaagacaaccccttgcaccaattttcccaggtcttcagccccagccagtttctcactttaaatcttccccattctccaggacttcctgatttccttctcattttccttcttgttcttttgttgtgttgttgtttgtttgtttttgaaacagagtctcactctgtcacccaggctggagtgcagtggcacgatcttggctcactgcaaccttcacctcctgggctcaagcaattcttctgcctcggcctcctgggtgggaatacaggcatgcgccaccaggcccagctaatttttgtagagatggggtctcgctttgttgcccaggctggtctcaaactccagggctcaaggaatcctgatgcctcagcctcccaaggtgctgggattccaggcatgagccaccacgcccagcctcctgcctgttctttattaaagctggagttatctgtcctgcctctccctgcctctccctgcctctcgacctgctcatttccagtctgctaagaacaggctttttttttttttttttttttttgagatggagtcttgctctatcacccaggctggagagcagtgcagtggtgtgatctcagctcactgcaacctccacctcccgggttcaagtgattctccagcctcagcctcccaagtagctgggactataggtgtgcaccaccacacccagctaatttttgtatttttagtagagacagggtttcaccatgttggccaggttggtctcaaattcctgaccttgtgatccgcccgcctcggcctcctgaagtgctaggattacaggcatgacccactgcgcccagcccagaactggtatttttctaactgcgaactgtttggtccatgcccctgaccccaagtccaggctgcacaggtattcatttgccttgacatacatcctccagatatccccaggttacctccaagctccaacacactcactctccttagccaggggatctcagcatgctcgctaggacaaccttcctcccccgccctcacatgactgggaagaagaagacaccaggcccgtaacaggtgacggcacggggtcatccgtgcaaatgcaggtagtaaaacacggctgaccgcaacgctgggctctggcaggccgggtacgcacaccatgccaagccccatggggagcccctgccctcattctctctctcacacaacacactgtggagggaggcaccattttctttcccattttacaaacaaggaagctgcggctcagaaaggtccagtgaggagctcaaggtcacacagctggcaaatggcggagctgggcatccaacccccgaggccaactgcagagcctgttcccaccaccagcagccagccagcccccttttgaggagcagggcaggcctatccccggaccatcagggaggtgggagatctccctgcaccctcggccccctcttttggggtgtgcacctgcctggggcagtccctctgtgcctggcagcagcggaggcttccagccatcagctgtctccccatgaccagtacaaagggctgtgtcccattcccctgtgctggggagaagtgggtcagggctgggcctgggtcctgccgaggaacagagggcacctccactgaacgggaggcttgggaggcccggtgccatctgtcgtgctgactatacgccccagggcctggaacggtgtctggcgcattttggggtatcatgaggatgtctgtggcctgagcaacagaggccaccgctgcccgctgccacaccccagccaggccctctggcccatggagtgacaactagaaccggtgcccctccctcgggaccctggacgtccacctgccaacagttgtgtgatccattcccaaatccacagagcccagggtgactgtggcctttggggctgcacagtcccttcccagacccctgtgatcactgtgactggaaatgacttggggtcccacggaggccgacgggtgggacaggggtcggtggagcaggcagcatgcagtctgcacagtctgagagaggcggcatttcctgtccttttctactgcatgtcttggccctggggaagggagcagaactcctgcagcctcggtttctccatctgtaacgtggggccatcgcaccccatcccagggagttacacactcacagctaatgtcggccaaaacagcctctgtcagagcgggttctcaacctcttcagtctatgcattgaatgcttgcaagcactctgtgagtgtcctgtgacggctgtaacaacgtaacacaaacttggcagctagacacatttagcctcttacagttctgggggtccgaggtctcactgggctaagactgaggtgttggagggcgggctccccacccaggctccagaggaggggctgcttgtgttctctggtttctagtggccaccacgttccctgacccatgatcattcctcagatcactccagcctccgctcccatcgtcccagctccccactctctgcctctgaccccctgccctctgatgaggatccctgtgatggcacagggcccacctgcattcgccaggaccatctcctaatccaccaccagctgattagctgacaagtccccctctgaagcttcattccccttggccgggtgaagtcacacactcacaggccccaggggttaggacatggatgtctctgggctccacagttcacttggccatgccaccccagcctctctctctttccctggtgaggctcaaggtggatgaggctttaatatggagtgggggtgttttcaacaatctttcgcagattgtgggctgactcatccaactgcaggcaccgtcctccttgtggggactctcaacaggatgcaggcacacctcagattgggcaccagcaagcaagcaggcaggtcctgcggccgagatactcccacactcttcctagtaaatcacactctccctgggtgtgaaccatccccgtcaatgctcagaccacaggccagtacccacttaaaaggcaactggctctggggtgctggtggcccagctgacaggtgccctgacttgcaggaggactcagaggacactggctgctcggggatgcctctgcatctgtgccttggggctgccggcacctgctgggagggtcctgcctcttgaagcacacagcggcaccggctctgccaagtcccccgttctctctctgctgctcagcgtggggtcccttttctcttggcaaagtctgacggcggaaaccccctgaataaacagctcctgcacagagatgtttctccgcggctcaggattcgcactggaggagaattcagaagtccaagcccatcatttgatgctgccaaatttccgccagcctcagcggtaaccttctctggcaaggttaaagggtctatcagattcccggcccagaaactaattagataaagaggaaacctgggccccctggggtatctcctcaaaggccgaaaggtgcacatccaccacatccaccccaccatgcccagaaatgggacccaccagcggcactgcctcagccaccctggactgtaaccatccaggctctcagccggatccctgctgtacctccacaggggagaggccagctcattcgcatgaagggagactgaacggacgctggggcacgctgagctccccagattactcacagcaaccctcctgcccatgccttttggtttgggaggcgacccaagcccagtacctaatggagtgactggggtgggagcacgaggcaagggtatccaggctccacagagaaacccctttctggataccagagctctaggttttagcaacagaaaccacctccagagatcttgaacactgtggggttctgcacgggcttcaggtcaaagatgtggaggggcggacatcaccgggctttataataacagggtctgggcatgctcggggtgaaatctaagggaaacgcatctgggtgtggccttcccccaggcaaggggctgcggcttttccctttcagagaaacaggagttcgacaacctggagaagagtataaggcagcccaaacctgctggagggtgctttgtgagagggcctttgacccacaggccaggttccaggactgatccgacagaaacgcaccctcaagagcaccacaaggccgggccagggctgctgctgctactgccactgtctgaactggaaatatttgagccatctccaggggacatgctgggtccaccccacccccggacggttactaggaaggacactgtctacacgaacccatgggcatggaagctgggcaccaacagagtgcagaaacaaactgcaggatgctgtgtggcggagcccgctgtgccccacaaatacatgagaggaggacacaatgatgttgcaaaggctggcgggaggatcaccgaaggtcaggagtttgagacctgcctggccaacatggtgaaaccctgtctcaaacaaacaaataaataaataaggctggtgggcacagccagccatgcacagtggccccttctgggaagtgggaccaggaggatgatattgactttctatatttctgcattctttgaatatcttgagatggaaaagtgggcactgttgttttctaaaacagacaatgaagatgggagggagagagggaggaaatgggggaggcaggtaggaggaagtttccggtttgcccaaggccacagagaaggaggcctggagcccttgtcctcccaggtcggggagcatcctggttcctttgttgaactcactctctcaggacccaagagcagccgtggatggaagaaaatgaaaagacaaaacgcaagtcctaagcacaggaggatgacgtgaggatggggaatgacactgctcttcaccgcaccaccgaggcatgggtcaggtgttaccctgaaggtgaggaaaccgaggccaggggttaggtgacaagtctaaggcagattggctggagaagggcaaagctgggacgtggccgagagggttggtgtgaccgctgagccacatcccctgtaagacgctgtctccctgatggcctcagtttccctgctggtctctccaccaggctcaccgctggctcaggatttgacaattaccgctccctccttttttactgaaattttttaattttatttttagagatgggatcttgctttgttgccctggctggtctcaaactcctgtgctcaagcaatcctcccaccttggcctcctgaagctctgggattccaccgtgcctggccacttcctcctttcttttccttagtcctaaccttcttcctgtctctggccagctctcacctcagcgagctccactctgccgtttctgtgtaattcagcaacatgccctcttccccacccaatccgtgctgcttttaacactttccttccacccctggaacttgccgccttctaccgatggtgcatctctgtgtctgttagctcactgatatgctgctacatgctctcagagtttcctgtggacactgtaacaaattgccacaaaccgggtggtttaaacagcagaaatgggttctctcacagcgctggaggccagaggtgcagtatcagcatgaccactgtggtgaaatcaaggcatcggcagggccacgctccctcaggaggccccaggggaggaaccctccttgcttcttgccgcttctggtggctgcagcaggcattccttgtcttggggtcaatctctctaatctctgcctctgtggtcatgtggctttctcctcttctagcttcatgatctcctttttgttttttttttttcagacagagtctccctctgttgcccaggctggagtgcagtggcgtgatcttggctcactgcaaactccgcctcctgggttcaaacgattctcgtgcctcagcctcccaagtagctgggattacaggcctacaccaccacgcccagctaatttttgtatttttagtagagacaggatttcaccatgttggccaggctggtctcgaacttctggcctcaagtgatccacctgcctccacctcccaaagtgctgagatgacaggcgtgagccactgcacctggccctggatgcatagttttgaataaatgaatgaaaagagagagagagagacctgggtccctgtccctgctactcactcttcatatccacggcccctctcccagggtcttcactgtccccgtccccctacccagtcatcacccttgaagtgtgaaaaatggctcccagagcctgaaaccatgaaggttcaaaggcacactcctggctgggcacggcgcatgcatcccagcagtatgggaggcagaggtgggaggattgcttgaggccaggagttcaagaccagcttgggcaacctagagagaccacatctctacacacacacaagattagccaggtgtggtggtgcacacctgtactgtggccccagctacttgggaggctgaggtgggaggatcacttgagcccaggaattcaaggctgcaatgacctatgattgcaccactgtgctccagcctgggcgacagagggaaaccctgtctcttagccccctacccccaccccaaaggcatactctctggtttcctaggagaatccggtttggtatctcacactcccttcacccaggaagcacaggctgtggaaagagtgtcaaggtgggagcaggtaaacccttggcccctgtccgtcactcagtgtgactcagtgagtgcctgagtcacactcagggccagggacagtgcccctggccctgccaatccagtgagcgttgttggtcccagccctgccctgtctgaccggctgcagcccttctgataggtcacatgcctcactctgcctcagtgtaccctttaggaagaagaagggactccagagatccctcttggctcaaatgcaaaggtgaggataatttgggaaaagaggcaggacaattactttgtgcattttggcagtgggaatgctgtgctgcagaaaggtgaggcaaaggaccctgggcaaggcctgaccccaacaccaccttagtccctgcctgaggtccctgacctcagtccaagccattcccccagatggtgtggccagaggactccagttccttaatccctgccttcccatctgacagtcccagaggcttggcgaaaaaacccccaaaaaacaaaaaactggcaaatgaaacccaggaaagaaaaaagctcccaacctccagtctgggcccctctcttccaatctgcttttgaactcgctttttccaccctcctcctgccgcccagaaaagagctgccatcttcctggctcctccccttcactcatcttggaggcctcagagctccacggggccaactccaggccaggggacctgggacacatggtgccagctgttataccaggcattagaccaccgagccagcctccaccttgaccttgggggcagtagagtcaggttttaatcagcacatgccctgaagagctaagccctgcttgttggttggcagggcctgggagtgcagcctctagtcctgacccatctgaccaagctccctgacagggaaagagagggaagcagattccaagctggaccctcccgaagacttggatgggctgcatctctttgtaatcctaagcatggggacaggtgcccagtgcttcattctgtcctggagagaacggggcagcagagccctagggaggacagggggcagtctcaactccttagactgccctgagcacttttcatgacatactccttggcactggggacacaagtctccttctcactggggccatgctatcctctccttcccatgaagtgaaaatttattgagtgctgacaatgtaccaagtactgcctatagagaggtctgagcacactgcccaactttggtccccacccttaccccaagtcacagattcagtcagccacccacccactcacccatccatgcatccatgggtccacccatgcactcatccatccatctgtctacccattcattcatccacctatccagccatgcccccacccacccacccatccacacacccatccagctccccttccttccttccttccttccatccatctatccatcacccatctacccatccatccatccatccacccatccacacacccatccagctccccttccttccttccatccatccatctactcatccacccatccatctatccatccatccatccatccatccatccacccacccacccacccacccatccacacacccatccagctccctatctatccagccatccatccttccttccatctatccatcatccatctacccatccatccactcatccacccattcacacacccatccagcccctcatctattcatccatccatccatccttccatctatccatcatccatctacccatccatccattcatctatctacccatccacacacccatccagctccccatctatccttccttccttccagccatccatcatctgtctatccatccatcttctcacctctctctccactcaactctccattctctgagagctggacatttgccagaccctgtgccagatgccagggagaaggagacaagtcagtcagtcctggtcctatctggaggagacacaggtgtagaaggacaggggtgggcagagaaaaggcagtcctgcatggcccaggtaatgttgagtcagggaggtctgattgcttctcactctagctctacaagtcaggcaccaaagacacctccctgcttcctggaggaaggcccagagcaccaggctttgggcagaggcggggatcagtgtgagcatttcccgaaaacctgctgcttcccaggcacagccttgggtacccctccagaaccagtctcctcatctgctccctggagaggcaccccttggccttgtatgccactgatggcccctgtctggaccccaactaagagcactcctgcccatcttgggctgccctctggatacctctgcccactctgggtcaggccctggaatcccaaccctgcccagcctgtctcagggtttgcagttttgtctaaagcgcattcattcatggtgaccactggccagtggttatggcagtttcaggcccaatgtgtagaattttatattcacaagagatctcagcaatgatgtaggcattttacaatgtagccatcttacaaatggggaaactaaggcccgtgcaggaaggtgatgtcagaactgggaccaggacccctggcacctgaactcccaggcctaggcctatcaggcttgaaacctgcttgctggagcttcagatcagcacacttcattaccctgtgtaagaccccgactcagagcacaaggttggagcaggggtgcagaggcacggatattgcccagggatgagccgaagctggctcttaggagctgccagggctgactgtgggcgcctctttccagcttgctcagtgacctcacgttggcagctcggaatgggccattgtggggcaatttacaccactgaaatcagtaaatgctaccaatcaaggtggatataagacaggagcacgagaggggccaggtacagtgtgggggtaggggggtgggcgggggcggtgtggaggcagaggtcagctttggcagctattgtcagaacagctccagagagaacatgactaactcctctcctttgcctgccggcggggctcagggattttaggagacagaagattcctgcgcagctacagagctcctgagctctgggggcccctgccccatccaggtggggagcaaggcaggcctctgggagtgccctcagtggggccctgcctgaaggtgctgaatcccagccccccaggccctcctctgctgctgctccgatggccccacccaccaccggtgtccccaccatccacccactcgccacctgggaaatgtactaaacgtggtctgaggctgctctgagccaggagcctccctgtggtgaggaactcagctcccagccccaaagcaggggacttgggtccagaacaaagcagccagaccttcctgcctggccccacagaaaaggccgtcatgagggtgtccaggctgctgagagcttggcctccctgctctccagccagagtggtcctggagccacttaccccaacctgaagaccaagtgcgcccagccccaatgcagaacagttgctgagctggatcccccctgcagggcatgaggaggcccctccccttctccaccctcagaacccatccaactgctttcagagggtctgagcgtacctccagccagaaaaacctaccctcaccttggtctggggccaaggtccaaagtccccaagtcaggtgcttgacgtcataaaactgcaaggggaagttggccgtggccaggtcggagcacacctaatttcgtgcacctaatttcgcatcactgagtactggagaaggaggagtccaggcctggcccagccaagccagcagccccggccatcccaagagactcatgacccactgtgcacccaggaaacatagcaagtgtcagctttatgcttggctctttgaaattatatatttcacagatgatatctaagaaatctgaatctcaaagctccgtgacagaggcagaatcacaaatgctcatttgcagatggcacaggcagagctgagagtggatgatcttgtcatggggctggcaggtggagaggctgggagggaacacgggcttgtctaactcatgagtctaggccctttgtgcctcactgccccctttcccatcagagagcctcctcccctttcatgactcggcagggacactgcgctcctgggaccatgtctccccaccacagctctatcacctggccacctgtgcaactcacttcaagataaacagaccagcacttcaattttcaatttggatcctactacttgtcccataggtatgcatgagaacctatgtctatctttgcttagaacttctggtgggagtggggccaggagcatgtctctaagcctctctttttggtgtttgacctgaggaacgtgcagttcacctgagctctgccgtgagagcagttacgtgcagagatctgcccatacctggctggctggtttgttcacaaagagatccggaaaccacttctctcaagctttagaagcttatcccattgttgaaaggaaaagctcttggacagtaacagtgtgattgacaaaataataacttacatagacaggttggaagttaaggacatttcccagaatacagagcaagaaggcaaagaaaaaaatcttgagaaagaataagtgacaaatggggagaacgtaaatggtctaatagaggaaatccagaaaggctgaactgaaagaggaagcgatggaattgtcaaggaggtaataaaataccttcttgaagtggaagctgcttcagtctggaggggtctccagagcaatgagctcaatgtgcaaaggaagcgcacactcacatccaccatcagatttcagaacactaagaaaaagtagaaaatatgacattcctacaaacttctagggaggaaaataaagggtcgctacctacagtggaatgagaatcagacagtgctataacttcttactggcaattctcacctgccagggataaacaggaacattgaataatgagaaaaagatcaattcagaactgggaacagaacccccagacacctgaacttccaggcctaggaccatcaccaagaagacaaaacagtcctgaatgagtacaaacctaacatcagaacttcaaaatacatgaagcgaaatccgagagaactgaaaagaaaaaatagacaaacacaataatattggagaatttcagcattcctctctcaaaaattgacaacagaggacaagtcagcaaggctctaagccatgagtagagacgggatggtgatgaagcaatgcctggagagttttgaaactggagttctacaacctggagaacatttgataactagggaatttccagacagggaggttacattccagataccttttgttgaagtggaggatgtatcctgacagaataagggcaaagaaaagaagcaactcacgtatccactagctcagtgaagtgaagttgcaggatgatcgtcgtgtactgagagctggagttcaaattggagcagaatgtcagaggactccaacaagaagaggacagattccagtgatacatcagaaaaagaatgatattttagtggtatgctcaagaagccataatttttctcccacgagaaaaaaaaaggcaatcagaaactccaggaaaaacaaaatcttcatgtgaaaatcatgatcctaatattaagctgaaatgtagaattactctgaaacactgatagagtggaaaaaaaactcattgggttgtgatactattagtacccttcttctcataggtctgtaaagaggaattggaatactaaccccatttgtattatcatcataatgtaatacttcccatgtttttttttttttttttttttttttttttttttggtgtctatgctggtctcgaatgcctgggttaaagcgattctcctgccttggcttcccaaagtgctgaggttacagatgtgaaccactgtgctcaccctccactgttttttaacttctgagtccaacttggagacaaaacttagaacccataaatataaatataaatataaatataaatataaatataaatataaatataccaaagggtcgagtgatagtgtctaaaatgtattaaacaagagagagaagtttaagaatgttatttaaaggtaatccattagcatactggcaagaactattcaaaattggaggtgagggtcaaactatgaaagcctcattttttccagcaatgtgtcaaggatgtttcacattttaaaattaagaaatacgggagtaatcatcacgttgggaagatacccaccagaagaatgaagcagacataatttaaaaacttttttttctgccaagtggggctgtgtggatgaggctgggtcagagtgggcacataataatttatttctactcttggccctatctctgtagtttaattaattactttcattacatgcatgcagtacttggatgaaaatttatggagggaggaaaaatgtgaaactgagagttcactgagaatggatgaggggaggggtccctggggcagccggactgtggggtgctaaggggaacagagaacatggacaagagccaaggggccagcccagggaaacagcaggaggacgaggagaagacaggactccttgacccttgtgatggactaaaggagggaaggagggagaaaggcaagggagaatgaggagggggacactcaggtcccccgtttaggcactgggagggctgtccatcacaatagagaccacagagaagagcagtactccctggagaaatggctcacccaaatggagacctggttccggccaccatctttaccatgctgggagagcgcaaaggaagagctgggccatctgtggttgtgatgccttcctttgcctatgcccagagaaatacctctctgtttcaaaaaactacaaaagaactatatacttgcaaaaataaaaataaaaatatgggccaggtgcggtggctcacgcctgtaatcccagcactttgggaggctgaggctggtggatcacttgaggtcaggagttcgagaccagccaggccaacatggtgaaaccccgtctctactaaaaatacaaaataattagccaggcatggtggcacatgcctgtaattccagctactcaggaggttgaggcaggagaatcacttgaaccagggaggcagaggtcacagtaagctgagagcatgccattgcactccagcctgggcaacagagcaaaactctgtctcaaaaataaataaataaatagtaaaaaaataaaaatacagaaaatgtatgaaataaacagtgaaataatctcttgccctgccccaaactatgcctcaaagaagccgccatgggggcttccaaattaactgcgaggcccagccttcagttgagagtaaggaacaaatggggtgtgcttccttctgtgtccagacagtagacatactcagggataaagccttcttttcaagtctaagaaataagaaaaaatatataaaaatacaaaataatggcggaggaagaatgagggaaatcaatgtttcttgccattcagttcttacaacctacacactgaggcagtcttctagagcgcagagttagggtttcaaaggaaagccagctacccacacacactgctcacaactcagcacccctctggatttatatagcacatgcctcttaggagctgcaagtactaaacatattttctcattcatccttaacacgaacacaactggagatacagaatgagttggaagcagctctactttgcaaacaacaggaactgaagactcagggaggggaggcgagctacccaaggttgcatagtgacttagctggaaagccagagagataacttaggaccggtgatttctcagcgtctttagaacgcttcagataacatgcatatatgcttctatttgcagggcccttctctagaaagagcctcaggaacccagcaacagagattctctctagggagaagaacttggggaccagaaggcaaagatgggagacctactcttcacactctatcaatttcctgcatatcttgaatttttaaaccaggtatatgtatttcttattactgatttagaaaagataaaaattgggctgtgaggctcgaaagccatgaaaatagggagctgtggacagtggatattcaatggtgagcaggcatactttgccatccttctaattcgctctctaagagaaaactggttttctctaagggagaacaaaaaacagatgctcagcaccttcttaaaccttttccttgagtggcattaatggacatgttccttttgagcagaccttgctgccagtaaggatgtgcctctgggagctcctcccggcaaaaacgaagagaaggtgagaactaagtcctccatgctcttcctcacctccatgtccatgcccctatccaatctaactccatcctacccctcagttccatccacctctctaccccacctcctccaccagccccaaccaccattgttgcttggcctgaataatggcaatgggctcctcactggtttccatccatcctgccatctgctttcctccagaaaagtgattcagatgatgtctcttctgcctaacgccctccaatgcctccactgcaagtgcgagaagacccaactcttttcatgaagcacgaggtctttctctgacattactgcctctaatctcttctaggccatggctattcctgcagtgtcgaatcttctcatcaccccagtgcttctgcacttgctgaaccttctcttgaggggtgattcctcctcaatctttgtgtttcaactcaaaagtcacttcttcagggagacactccctccctggcatccctacataaagccggcatgacccaacctcccaggattctatgacagcactcatctgcttcatagcattaactacaaagtgagatcctctgcttcatttgttaactttattgtgtacctttactaattagactgtaatctacttgaagtcaaagaatgtgcttgtcttgtttatatcctcagctcccagaatagtcagatcttgataaatattcattaaacagatggacagatgaatgcagtggttgggtggatgggtggatggatgggtgggtaggtaggtggatggacgggggagtgaacagataaatgggtggatggatggatgaagagatacatatggatggaaggattcatacatggatggatgaatggatagatggatgtgtggatagacggacaggtggacaggtgactgggtggatagataaataggtggatagatgagtgatagaaagataaatggctgagtgagtggatggcgggaaggatggatgtataaatggagtccgttcagcctaaagtgagaccctgagttctcccccatcccaccaggtagatttctctggagtatcccatgatgaggctggggatttggttaacgaggagtgggaacttaagattcccattccctgagtggagacatgtttttaaaaatgacattgaaatatctgtaaagtcccaagtagaaatggcccttagggcc

SEQ ID NO: 638 - DNA, 123471 bp, Homo sapiens
tttctaaagcacttttcccaagattatcgcacagtatacacctgctcggtttcaagagaaggtccaagattagaacgaaggccagtctcaggagtgtgcagcctaagcagtcacacagcgtcccacacttagaagggctctgcacgcttgaattaatgctctactgccactgacttgaaatgcttaataatttttaaacaaggggccctgaatttttattttgcactaggccccacaagttttatagccagtcctagctaaaacctttattttataagagagaaagctgacccgtagggagcagatgtacttagtctaagttcacgtgactgaaagtgcacctcaggggctaatgcatttgcacttagctgctttcaggcaccagcaactagactgaaacaggccttcagtgtgggaaggcattcctggggttcccgtggcagaaaggtaggggtagctggaatcacagctccctcacttgttctaaggatccaactcagaactggagaaatccaggctttagggagctctcaggctcgtagggaagcagacagcattaagaaaatacaattggaataggagctgaggaggtgacagcaggacaacacctgttaggggctatctggtgtcccccaaaattcatatattgaattcctaagccctagtacctcagaatgtgactgtttagacatggggcctttaaataggtaattaagatagaatgaggccgttagggtggtccctgatccaatatgactggtgtccatgttaaaaaaggagattcagacacagacttgtgcagagggagaaccatgtgcggacgcagggagaagtgggccatctacaagccaaggacagaggcctcagaatgaaccaaccctgcccacaccttggtctccaacttccagcctccagatctgggagacgatgcatttttatggtttaagcctcccagtctgtgatgctttgtcatggtagctggagcagactagtataacatccttcattcctcccactcctgtgaaataaagcctatgactctttcacagagaaagggcccaagactttaaggggttaactatcttgctcagggtcaaaccagtaggcagccatgccaggacttgaacgcagcttgatctgtccctaagcctgtgttttccactccaccagcctagggggaattgcaccccaattcgcccaattcagaaggtctgaatccctttcctaggcatgcccatccctctgctgccctgtgggctcagggacttcctggcacagatctcccaaccccagactcaaagcttccctgtggtttgcattcctgccctagactaagaggactgccgtggctggatcctttgacagaaggactctggagccatatcaacatttaccctaaccctaaggaccaaacaaaagagtgaatatgacaagcctttataagtgtcacacaccagagttccaggtgcatggggttcatgaacaccagcactaagggaacattcttcctttactattaaagtagctacatcaggaaatcacagattctgttgcctttatgtggaggagcaattcagctctctctgtgactccctcatttcaacccagaggcagccaggtatcttcctaaacaaagagctatctacccagggacaaccatgttactcgcctgaaaagcaaaagcaactgcagatagttaaggagatttttcttctttcttcttttgttaaaacaattttaggttaatggtgctttattggggtataacatacatacaataaattacccagatattgtgtccaacttagtgaaaaatttaacaaatgtacactcccatggaaccatcattcttgttgatatggcagttgtatttttaaatagaaatcccaccttctttagccaggcgtggtgacatgtgacagtagtttgagctactcaggaggctgaggtgggaggattgcttgagcccaggagtttgaggctgcagtgagctaaggtcacgccactgcactccaggctgggtgacagagcaagactcccatctttatttacaaaaagagaaagaaaatcccatctctctgctgcgaggcttccgtgccatgatgaagagaacaagggctggggaagcacagagaagagtacaaatccagcatggaggaatcctgaaagcatcccctcgagcgtgtgacagacaggtaagctagatcttgtaaagagtctgctgagaggagacagggaataaagggacattgtagacataaggataagcaaaggcttaggggtttccaacagcttaggagaaagagttcagagtaaatacagcagaagatggctcatggggtgccatctggggtcaggaacagatatgattatataaaaatgaaaccaagcttgctgtctgatttagaagctatttctgctaccagaacagtcagtgcctgtctaacgttcatgtcaggttttattgcttgtggtcaaaggctgtcgcacagtacacggagcaaagagcagaaactgcatgatttttcagaacaacgtccagaataaatatgaatctctgccttaaatgggacattgcagagcaagttacataaagaattatcagtctaatagatcacagcactagttgatcaaaatacttaacatcagcttagcacggacgtttaaagcagtcagcatcaaagagatacttaaagttgtaaaacctaaatgcatgtttcccctcattgtccccacgtcattttctccctctttaaacgcttgtcttactctattgcatagaattcatctttttaagctgttttaaatcctttctggaaaaatgaaagtatacaatatacacagattaccacatacataggtgcatgcctgtctgtctcagaaacggcctatcatttcacatcaatttttaataccacccctaccataaaccagattgccatatgcacataagcctgtttcaagactatttcttctgttccaatagtccatttattcgttcctggtagtataccacactcttacttactgtattttctttcatctaaacaatcaaacattctcaagtctttcccattaaaaaaagaaaattctcccactgccacccccacatggccactagctaccatgctaactctctttccacccttttacggtcacatttctcaaaacgtctgcatgtggccctctgtttcctcagccacttttcaatcctaagccacggcaatcttatttctactcccaccacaccacacaaactgctcttgctaaggtcaatgagcttatgttgctaaatccagagggcaaactccagccttcactagcttcacccaggtgaccacttcctctccctttgcttctgtgcccttccatcctcttgggtttcctgcagttgctttccttattttccatcccccttcttggcctctcctcctcttcccacttcttaaacacggaagctcctaggatttcggggctgggttacattctcttaacaggctcaccacagtttacctaggagcactccccctcatctatggcttccaacattacctgcaacatggaccatgctgcatgttcaccaaacacggtttccttttcctgctttacatgcagttagaccacatttcctggaatcccttttgattatgtgccactagcttctgaccaatgggatgtgggaagaagagatgtttaacacttgcaggtctggccactcaaacctcacacgtgatcttccatgttctctcttttcattcatctgccagcccggtgccaaaaaaaaaaaaaaatgccagtggagatctctgagtgcctaggggcccctggaactactggacaagaggaagctggatgtctaataccctgaataaaacagagcccggcctccaccccaacccacccccactgactttgaacatgagtgaaaaataatcctttattgagtcagctcactgaaatacagaaattgtttgatgaagcaattaacctggcccaactaatacactatctctatgctaatgacaaccaaatatttgcattatgggcctgttcttctaattatgcatcaaatgattgacaatgcagcccaaactgatgggacagatagtttttttttaatagattactaggaagtcacagatattcatgcatacattcattcattcaataaatgtttatcgagtgcctacaggcaccagataccgtgctagaaactaaggttgcaatgatgagcaaagataaaaccagtccattcactcacaaagtttactgtgagcctgatgacagctgattctcatgtctcattatattccagctgcgagaaacttctgtagcatttgctgcttcatgcaagcccgctacccataaaactgaggcttcccctctctagatcctggaatccactgttctctcctctatgaaagggtgcaactggatataatagtataacacccctttctcttaagtattttgtcagttttttattgtagtaaaatatatataacacaatctttttcaatgtaacaatttgttgctaattcagtggcattaaatatatttacaatgttgtgtaacttttaccactatctataccccaaaattgtcactatcaacaaaaactccatgcccattcaacagtaactcctctttccccttcacctgagcctccagtgacctctattctactttctgtctctaaaattggcctattctaggtacctcatataagtggaatcatataatatttgtcctctgtgtctggtttttatcaggaagcgtagtttttaatagtacatccacgttatagcatgtatgagagtttcatcccttttcgtggctcaataatattccattgtatggctagaccatatcttgtttatccactcatctgttgggatgcacttgggtttctacttttggctataatgaataatgttgctatgaacattggtgtataaatatcttttcaagtccctgttttcaattcttttgcatctatatcttgaagtgtgattgctaggtcatatcataattctatgcttaaccgtctgaggaactgccacactgtttcccaaggtggctgcaccattttacattcccatcagcaataaatccaggttccagttattccacatacttgccaacacttgttattttccttatttttttattatagccgtcctagcgtgtcctagcatgtgtgaagctgtatctaagaacagttttaagtataaatgttatatatgaatacaattttgttctgacaaattcaaacccagaatagaatttaaaaatccacttcactgtagccacgtccaacctccttcccctctccagagaaaatcactgttaaaaatttggtatgcatctttcctgatcttgttctctgcatttgtgttctttttttttcatatatggatttttttttatggcagaatttttatatatttataaatcagttgggaaaaggtaaactattcaataagtgatgctggaacaaatgagtctccatatgggttcagaaggaaaattttgccacccaccaaaaaattaagatgaaatagacacgaaacatggaaaacaaaactataaaacttacagaagaaaacacaggaaaatatcttcattatacgtgggcaaacacagatttctttttttttaaattttatttttccataagttattggggtgcaggtggtatttggttacatgagtaagttctttagtggagatttgtgagaacctggtggacccatcacccaagcagtatacgctgcaccatatttgttgtcttttatcccttgacccccctcccactcatccccccaagtccccaaagtccattgtatcattctgctttttgttttgtgttgttttgcatttgtattcttatgtgtgcgtgaatgcaagattatgcgtaatggaaacatagccattctgtcactgtcagttttcttccttctttccaactgttccactgttgttgttgtttttttctgttagagaagttccacttcgaaaattttgccctttagcttgtactgctggttataacgtggtctttgatttccaggaagagtatgctgtgttggctgaagtcactagcagaagaactttggtgtctgcctcatgtagaatgcattgcctaggtcgtctcaggcctgatctgagctgaacttctcctatcacatatgccaacaactctttatgcttctctctttctctgaaattaccttcttttgtctggaaaaaaaaggaatgaggaagatttttcaccccttcagagaaaacaactatccaacaggacgaacgtgggaaacagccagtgtttggtgagagatcgccctctgctgcctgtgttaatcagggttctccagagcagcagccaataggaaagatagatacatttgtaaggagtaacataatacatataaatatacatatttaaacatatatatttagattataaatataaatctatgtctatattatatataaatatatacaagttggttataaggaactgactaacactgttatggaggctggcaagtttccagatctgcagggtgagttggcaagctggagatccaggagagctgataatgtagttccagtcagagttcgaaggcctgagacccaggagagctgatgacatagttccagtccaaagcccagcaggctcaagactcaagagaagccgatgctgcagtttgagtccaaaggcaggaaaaagccaatgtcccagtttgaaggccttcaagcaggagggattctctcttacttgggggagagttggccttttttttctattcaggcctttaactacctggatgaggcccacccacataatgggtggcaatctttacccagtctcctaactcaaatgctaatctcatccagaaacaccctcacagacacaccgggaatgacgtctgaccaaatgtctgggcactccgtggcccagtccagttgacacataaaattaaccatcacactagccatatgggccttttagggagcctgaacccatagcaggaagctctggtgccttgagcaattgtccggatgggcattataggcagttaaaattctaagcaagaaagattaagaaaaaaacaaaagcgtgtaggccaaactggagagaaagagagtgcagtggcaatgctattcgggtttctttcctgctcagaaccccgtgatgactcctcatcccccatagaacatacccttaccttatggggtttgtgaggcctgactcactgcctgcctcctgctgccaccacacatgcttcttcactgttcctcacttgtgccaagcctgttgctgtttcagggcctttgcacttgctgttccatctgcctgggcactctttcccagatccttacagggcttcatggcaaggccttccctgaccaccctccccaaaatagcaccccctccatccatttccgcctccttacccccctttatttgtttgagcttgtttcctgtcttcttcactaaaatgtaaattccacgaggccagggactttattttttttctctgcaaggcctggatcggaataggtgctaagtatttgctgagtgagtggataaatgaataaatgaataaatgcaaaagatagaaggaggggacagatctagtgatggataaaaagcacatacgaaatggtgtggatcctaacgaataattaatctggggaaagctaaagctgaaaatgaattgaggctttaagaaaatgctgaagacagataagtaaaatgccttttagtcagtgtaaggaagtgtgagagcaatttcttggaagaaaataaatcctcttttgttggcatttttccttccagaagattgatcttcaagctaaagaaaagttggaggagagggaggagagagagcgggaaatccagacagctggtgaagttgctagatcccagaggctccaaggagcgattgattgcaggggatgtctagatagtgacagagaaagcgtcatagagatccccaggccccagagcagcaaggaagcagcagcctcatgccctcaggcatggcataaaaataatgctagagctgcctcactgaaaaaaatcccgaagggccaggaagcaggctgaactcagccaatgtctgtatggacagaggatctctaaaccagcccccacccccccacacacacacacacacacacacacacacacacacacacacacacacacacacacacacagagctatggcacaatgctatgggtttgcatatttttctccatgccccccagaatgatgtccaaatctagagcagtgggtgtgaatcttggctcgtgaactctttgaacaaatctgatgaaaattgccacatgtgcattatttcagggaatttaaggaaatttcaggaattctcctccaggcgattcatggacacctgaaatccaagtgccccaggttagaaactcctgttctaagggtatattcctcaattgcagcacttggattaatgatgtaactccttaaccctagagttgaagattgcagccaaattcttagtgtattcattcaacaaatatgtattgattgactgtcatgtagcttatttaatcctcacaactgcccttgaagtagattatattaataccaccctcactcttgacagatgaaacaaacgaggtactggggctttgggtaacttgctacaggtcactcattttgcactagtcactagtaggagcagagccagtggtggaaccccagaaattcagctttagagacattttactgctaccccacgatgcctcttacgaggttggcatctgtctttcagatagccccgttcaccctgaaaacatgtctcttagactacatatagtaggttagacatgaaaatcccaccaccaacgacatccggaggctctgtcaccctgcctctgcttattcatcgttcccatggtttgctgactcagttttaatcattggtttaccttctggatctatttgtatgagggattgcacaaatatttccccacatccaacatctcgcaaggagatggactcacgtgcatgttcaagttcagtctccaagttgagaagaaagctttctggtagcaatgctgcacacacccaggggctcatggatctctcaggagaggccacatccagtgtccatgaagtcatgagttctgcagcatagattccaagttcagcttttgtttcatcaacattactgtgtgcacttctggttgagacacttaggggaacagagaaagttcttcagtaaaagagaggatgtatgagcttcctgtggcttctgtaacaaagtacccatggactgaggagttaaacaacacaactacatggtcttgcagttctggaggctggaagtcaaagatcaagatgtcagcagggtgagctccttctgagggctgtgaagaaaggatgtgttccaggcctctctccttggcatgaagatgactgtctttgccctgtgtcccttcacatcatcttccctctacacgtgtctgtgtctctgtccaaatttctccttttataaggaaataaatactgtaaatatatatatattttgcactataatactggaaatatttatatattcctagtgtttatttatatatgtatattcccagtattcatatatgtatatatttccagtatttatttatatatttatttgatataaggaaatactggttgtattggattaaggcctactgttgtaaactcactctaacttgattacctccacaaataccctacccccaaataagttcaccttctgacgtcctagcagttaagacaccaacatatgaattttagaggtcacaattcaactcataacaagggataatggtcaggaagaaaaagagccacagaatgctagacatttttaatgagttaataaatccttgctataggatcaacaaacttagtaagttaataaacctgatgatggatggatggagcattgtaccaggcacaaagcccggctatgatgacatcaaaggcaccctgctctcttctgttgagaagtgttcaaagtagttagggagtctcaatgagcccatgtagcaggtaagcaatcttgatcgctcacactcaaaaatgcaaatgtatcattttgttcacttatagctagacttaatagggtatccattcaaatgacctgtcattccatcagtgcccacacctggtgactttttccaaggggtccacagccccaccaggattctccccactgtggcattatctccatcacaccccaaggctagatgagaccacagccctccaaggctaaatgagaccacagccctcttggggcactaggaagatccagcttaaaccactgctgaattcaaggtaatttagtggcactgcctcagaacctctctgtcctggcaccccacctagtggcaagggacatatctgcaagactgctgtcttccagaattccagctgggacgcagtcctctatttgaaaacaagttttctggaaggagggagctctgaggaggagtttcacaaggagaagaacacagatttgggataagatggggggacaatatttcagtagggacaatgacagagacatgagtacatatatatatagcaactaactttatatgaagggaaacacacatagacatgtattaaggacacggtgtccaagtcagagggaaaaagaaaaacaggctaattaatgagcagccatcatctgtggcaaagaggcatcaggctctacgctagcctttgtttgctgtctttgacctctctgcacctttgttttctagatgagcaaactgaggcttgagggggttgaatcctttcccccaaaaccacagctgctgggttgaagagttgggattttaaccaggggcggctgaatcaaaaggctaggtctcttccctgagcaaaataatggcatgacaaagacagtactgcagattgtcttgggaaaagacaggacagggaaatcagctaggaggacatttcagcaatctgaatttgagttgaggtggtggcttcagaaatgaaaaagaaaggggtggatgagtgtgaatactgtagggaaagtctgggtgacatataaggcaaagacaaaaaagaaaatgaaaatgacatcaatcctctaaaccactgcatcagaaagataaaggcaaacggtggtggttaaggagaggcttggaagaccagatgactgggaggctgcagggaaaagctagaaatgagggtaactttagctccagatacagcaagtgctgatggcgatgttctttgaaatgggtccacaaacccacataagaatttggagggctactgacagagatttgggtcagcaaatgggtccgatatgtccgagcatggcacacaaggatgatgtctcagcttcacagctgcagctgatgcagaggcactatttttgctacaactgaagatgtggccattccagcggcttccagcatgtaggacgatgaactaagcaggtcatgagacatggagtggagaaaggagcaacctgctgtaagatacttctcactaatggtgatggaggagctagctcaaaaaggggtagcttctgcactgtgcaggaacttgacaccatctggacagcaagccggtccagtccaactgaagggtgactaagtgtatagtgggctgcctactggcctagagtagtgactaagttgcaattctcgttaaactgttgttttgagtgtattacttccttctagcatattgtcaaaattctagtattcaaaggtgtgacaaaaacataaaataaagttgagcagccctggaatacagttatccttgacagcaggagtccctcaagggaagagctgctctaagatcaagttttgaggttggcccaatgacagtcagacatcctggcacttgaggttgcatttgaaaggtcagcattctcaaaagccagattgaactttaaggaaatttcccccagtggatggtagggagccacgtggtccctgagacacctgggtctaacctcacagtctaactcctaggcttcctaaagaggtggttaaacaagaaaagtggtaaaaaatgtgttctttcttctcttcccggtcatcatagaacttaaaaaaatctcagtcccagcagctgttccatgtcttacagagacagaaactgaaccacctcctttcttaaatcatttcgttatatcaggcttgagcatgtctaccaacaaattctgctgttcacagtagttctaacacttggaagcaaagaaaagacgaatctgctggacaggtttttcaaggaaatttagcacaaccctaagttattaaggaggcccacaagaccaaacacaaactgactattctccctctccgtccccctacccttcctcccctccggctctctggtccatcctcagggaactggcctgcattccctagccctctccaccatcccgccagatctctctagtccaaccccatatcaactgacctctgctctctctccatccccatccccttatcccccccatccccctctacctctctggtccagccccacatgaactaactctgggctcaatctccttcccagtacccagtccattgtgagatgacctctcttgctccctatgtctctaagcctttgcacctgtttgctccatctttgcatgaactaatctctgctccctctacttttccatccccctcaactcctctggcatccctctggtccagccccacatgaaggaacccctgctccctcttcctcccctttttctccaactctgattgaactttttagttcaacctcacatgaagcaatctctgacctctctagttcaaaattccacccccaccctcctgcagctctccagtccaaccccgcatgaactgctctctgctctctcctgtgccctgtctccccccattgcactactgccctctgccgcagctgcacatgaatgaatctttgccctctctccagcccaatccctacacgcaaccgacatttctttggtccagccccacatgaactgccctctgctttctctcctgccccttccccaccacctccctacattggtccgtcccacgctgcatgaactgacctcagtccctttacttctgatcttctcccactccccagtgtccttctggtccagtcccacatgaactgacctctgttacctctccattccaaacccaccccactcctccatctctctggtccacccgcaagggctgacccctgctacctctgtctccctgcctgtcccctgcagctctgaaatgaccggtatttgaacccactcaccctgcctctccctccctaacaacaaaatgggaggcagggcccagtcttttcactcctctccaatagtatatgtctttatgcaatcatatgccaccttcacaccccttagaacttacccagtcactctccctacatctctctggtccagccctccatgacatgaactcagctccatctcctttccttccccttccccaccatacatctctggtccagccacacgtgaactaagctccgttccctctcctttcccttgccccacactccggctacctctgcagatacagccacacataagctgtcctcagtggcttttcctttccctctctgacgctctgcatctctccagtgcagctgcacaggagctggcctcgaatgcctctcccatgccatcccattcagccttctgcatctcttggtacagcctacatgaactgacatctgctccctctaagtgtgcatcgccacttcatccccctccagcttcctgggccagccccacatgaactgtcatttcccctcactccctcacaactctattgtccacatgaataagccactaactctacaaacccacccactgacactcccatgaaaactcagctgcatcctcacatgaactgatccctgctccctctcactcccttccccctacccctgctcccctgcacctctccgggacaccccatgcacggatcttttctacttctctgtccctatcctctgcaatttcccttcatctcttggtccagccccacgtgaactgacctcagttacttctccatccacatcctcccccgccttcaggactcttttctgcctccacatgaactgagcccagctccctctccttccccatcttcctgatccctttacagctctctggtccagccccactgactcatgctccctctccgtccccatcttcctgatccctttacagctctccggtccagccccactgactcatgctccctctctgtccccatccttccactgaataactgcacacctatgttagaatggctgccaggcaaagaccttatgtttgcttttatcctcagggataacctattacttgccactctccgtcctgtctcaagagattcctgagagatttcatttatgggaatattaagcaggaggagataagaatgtctccaggatagtccattagcttaatttagccattcaacaatgtatacatctttcaaaacatcatattgtacaccataaatatatacaatgttgtcaatttcaaaacttctttttaattaacttttttttccttatccctgaaactgtttttttttttttaagttaagttccgggatacatgtgcaggacgtgctggttgcataggtaaacgtgtgccacggtggtttgctgcacctatcaacccatcacctaggtgttaagccccacatgcattagctatttatcctgatgttctccctccccccacacccccacccccactgccaccgacaggcccctatgtatattgtccccttccctgtaactacgtgttctctctgttcagctcccactcacgagtgagaacaagtggtgtttggtttcctgttcctgggttagtttgctgaggataatggcttccagctccatccatgtccctgcaaaggacatgatctcgtttaattaactttttttcaaaagagtgtttccagggttacagttaacagtaaaattggaggcagggcccagtcttttcactcctttccaatattatgtcttttatccaatcatatgcctcttattagaaaatcacaatacaacaaaggtcaaatcctcctaggaaatgctatcaacacactttggggacagtaatgataaaagcttcatggacccacatttaacaacaaagcttatgtgataactgtagcaaaagaatgggagtaagactgaacacttctgaatcctcttgttcttgaataccttcaagccaggtcctctctgtaagtttgtatttcacctccagtgattctgagtaggcacaactcttctccccatcacacagacatcaaactccaggcacctagagaagtagcttgccccaaattgcccgatgaggaagtgggtgtgtgtgagaatccagggtttgggctagtctgggctcttcccccaagtttttcttaaggagcagtccctcggcatgagactcatctgggggatatggtaaacttcatattcctgggcccccaagtcctacaggatgtcagggtccagaggcatgagaccgagggccaggcttctggcctctgtaacgtgctccccgggtagggttaccagtggcaatacaggatgcttaggtaaatttgcatttaagatcaacaatgaataaacaaaaaatacaaatgggatatagtcatactaaaaaaaaggcatcattgatctgaaatgcaaatttacctcaactttctttttattagctgaatcaggcaaccctatccccagaggactagcctacccccagaagtttgaaaatctgttttctccctctccatgtgaacaaacgagcattccatcattgttcattttctattctccctcaccccttctgcctccccactctcaccctggagcagagactttaatgtcatctaccaggatttctcacacagggaatcccgggcaaggccaggaagatggttggatggggtcactcagcccaacccacctccaagagtcgatgagataccataagcaaataaattcacgagaggttggctgaatccatcctagtgttgcgttagcctggctctccccattttattcaagcacaaattactaacaagactcttttccagtcttagctttgccaaaactatttttagagcatcatttaggcttaggtgatataaaaattctgctagttttacaaaccagcagccttccaaggcaaaaagcaattcatgccaggaaagtagcaaaggattattcattttctgtccataggctggtaaggagttttgtatctaataggctgccttcaacacaataattgagaagaggaactcataagcaaagctaaagaactcatccttagagaatacaagttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggtacgttgccgtgcctgcctgcattgttttttgttgtggtcgttgtagagacagagtctgagtgtgtctgttgcccagctgagagtgcactggctaatcacaggcccaatcatagagcactgcagccttgaactcttgggctcaagcagtcctcccatctcagcctcctgagagcaaatgtgcgccgccacagcaggcttgcactgttttcacaaaacatttctcttatcaacagagttctgttgttttgagaggcaaggcagtgatccagcccagtggcaccctgtttcatctgttcagctcctctcctaatgtgggacactgggctgggcgacagtaagccagggagcaggaggggctccttccctgcagctcaccctcagaacccttcaggccagtttccaaagggcatagcgtagaggataattcctcggaatgaggagagactgtgctgccctctgctgatggggcagggggatataaacataaataagacagcctttgcccctaaggcacttagaatcatggacttaagatatgttcgcaagcccctgtaatgccaggcaggacatgatacacacacttaagacgcagtggtaaatgttcagcttctgtcgaggaggtgatgccttgagtcggaccttgaagaatggataagcagtgagacttcactgtcgaagttggcatttcaggctaaagatgtcagagggtcacagtcaatggcatgtcatagtttaattagcagcacgttgtgtttcttaggggtccatgagataacggtgtcttagattcagtgaaggacagacgtgccagcctggtttggctgatggtgcaaagctgaaggggatgtacttttatctcccaggcagtggtggccaagaatcaaggaaaccatcgtggctcttacgtggagccttcagacaagaagcaacaaaggcccacgcgatgatggagttgggcgggggcggtagggttgggggtagaaatgaagccttacaagaaatggcctggagggggtccgcgctcagcacctgatttcctgtggggagtgagagggagggaggaggccactcaggctggaatgaagccgcagagcagctctaagctggtgggaggatggtgtcgggcccggagtgggtgaggccagcagaccttgctgatgagcaccaaggaccaaactgccctcagcttcgacctaaccactcgctcagaaaaatactagctgccatctagaccaaagatgtccctcatggaacgtcttctctgccctctcttcactcattagaccacagataatcgttgggccctgccctgcgcttcagtggtgaataaaacacgcagcccacagaccaatagattattcaaaactgctgaagtttccaaaaaagaaaagtgcagggtgctatgagagggacatagggctgcaagcaagcctggcccaggtggcgatcacggcagaacagttgcagaaacagtgcctgctcagatccgaaaggtgaggctgtgcacagagaccctgagccccccgctggccaagctgacgacctcccagccgctccttgtatttccctgcattcctgacccacacctatctcgacccacccgtttggagaaagtctaaccaccaggaaaccataacctcagtacccgctgagagcttgttagaaaccatcaggccccaccccggagctactgaaccgagaccctgggcttgggccagcactctcttcacaagccctgtggatggtttctgaccagtgaagaagccttcctgcagatcactgagtccagctagaacctccccttggctgctgcaagactgaacttgccctactcacaggcccagggcctgggggccacccccacccatttctttcctgacagctgatggcatcctagagtgcggacccaggcctatgtctgtccctcgtgtcacatcccatctggagaatcggggccaagggaaggcagttctctcccagattggggacagctagaagccctattgccaagtgctgcgtgtcctttgggatgatcgcattcaatccctcttccttcccttccctatcgacactgacctagttcagcacctgaccccatctgcacctaggtcaggtgtcctgggacagccgacctgatctgtctgcttactttcgcccctcctcccatccagctgctatgtgtacacctagggtatccagtctctctgctaaaaacactaaagcagggtccgattttctcccagcccacatttccagctccttccactggtcttcacacctgctgtgttgtagccaaatggaaccacggtttcctgttcacgccctgtcatgcatcccctgctcaggctgtcatgactgcatgcgatgtcctctccccactgtgtcccagctccagaatggcccgttcccttcccctaaaaagccatgcctaatcctcccagttggaaaccacctcttttctctggattcccagcctggggcccctgacctgtacctcattttgtgtttcctatttgtgctttttcctgcccccaccaggccaggagttcttaaggacagaggcaatcagtgtccccacagcatagtgggtgctcaggaaacctccctgtcttggaatcctggagtcacagtagcaacaaaagaaagtggtcccaggaatggggaaaggcacagcccatgagactgggttgaagcagagagaggttcccaacctgccattcagatggggcttgaggagtctgtgaactccctaaattcgatgcagcctctgggggtgtgggtgtgtgtgtgtgtgggggtgtgtgtgtgtgtttgtgggtgtgtttgtgtgtgtgggtgtgtgtgtgggggtgtgtgggtgtttgtgggtgtgtgtgtgtgggtgggtgtgtgtgggtgtgtgggtgtgtttgtgggtgtgtttgtgggtgtgcgggtgtgtgtgtgggtgggtgtgggtgtgtgtgtttgtgggtgtgtgtgtgggtgtgtgggtgtgtgtgtgggtgtgtgtgtttgtgggtgtgtgggtgtgtttgtgggtgtgtgtgggtgtgtgtgtgttggcatgaaagggcacatggctttcaccagcttctcaaagaggactgtggcctaataaaaactagtgagtggagggggccagcagctgtcgggggaggggccaggagagacatgccaagggcagagtggggctcccaggcctcatcgtcacccctgtgtgtgtgtgtggctggctgttccatcatggggtccatggcttcaaaacagggaagcactggaatccacgaggaggagggcttgccagacaggatggcaatggttgaggcctctggccccagccctctgggctctggtgcccattgcccctggaagattcttagctttctggatgagacagcccttgctagtagaaagctctaccttctgctgaactgaaacaccattggatgtgacttcccttgtcctccctcatttcctccctcaccaaaccccagcaagtgcagcttacacaggcgctattccctccggtatcccgcagctcatcagcagcactgtcctctgctcagctcacctgcctcagggcacctggtcctgcagggccagccactcttcttcaaactccatctccaacatcatttcttctttgcagctgtcccccacaggtctctctggcttcatacaatggctggcctacatctccatcaaagcacttcctccatcacagggcaaccatccacttagctgcccagatagagctctatgaactgctttgctcctcaagggcttttgattcgttacctgttccagggaagtaagcatgcccagttcatgtgccaagactccaagggcatttacaggagaaagccagcaactcattggcaatctgggggagccccagagaaaagaggccatggccaagggcactcaagggcagtcagcagagccagggctggaccactagctcctgatcccccaggccagcgcaccccaggtcacccattcagatccaggcagcctaatgccacataggtgcccatgtgggaaggaggcagtcaggatatgggctccaccctgaggttctcttaacatgaagggctgaaaaagcacaaatggatcattaggaactgtgagaaagaagatatgttggcagacactagaaccttccattccagtctgtatctcttgtcaccagcactgcctagtcattgatcgtggaaggctccaaaagatggtggacccaaagtcgagactctttgccagctctgcctcttaccggctccaggaggtctgttcatattaactcattcggcccagagaatttcccaaagaactttctagagtgactggggtaggggagaaaaggagggaagaggatggaggcctctcagcttcttttgtcctgtatcacagcctggctcccagcaacacttttgggatgcctcttgtagcaggtactgggagacatgcacaccactggctttgttctccatggtgggcagggggaacatcaattcaaaacattttaactgggcacctgccatttccctcaaagagctcacagtcccatagaagaaatgaaatgcagaaattaataacccaagcactccttcctttaagagcagaggtcagcaaactatgaactcaggctccaatctcgcttgccacctgcttttgtaaatacagtttcgttgtcacacaaccacatccatttatttacataatgtctaagactgccttttcactacaatagcagagttgagtagttatgacagaggccatctagcctacaaagccagtcaaaatattgactatcttgcccttcatagaaaaggttttgtgatggaagaatgaggtcagagaaaaaaagaagaaaaggaaaggtttgtcaacctctgcttaagagggactgagaggccacgagcacacgatgcttagcatcactaatcattaaggacacgcaactcagtaccacgatgcgacatcgcctcatcccattaggatggctactatcaaaacaaaaaaataggccaggcacaatggctcacgcctataatcccagcactttgggaggctgaggcgggcagatcacttgagatcagaagttcaagaccagcctggccaacaggatgaaaccctgtctctactaaaaatacaaaaaattagccaggtgtggtgacaggcgcttgtaatctcagctactcgggaggctgaggcaggagaattgcttgaacctgggaggcggaggttgcagtcagccaagatcgcaccactgcattccagcctgggtgatagagcttggacttgataactccctggagggtgacatggtgacatttgtgtttggatggtggggagagtgcagggagagggaccagaggtggggcgccagtggggaactacctctagtccaggggagagacggtaagagtgtgtctgtcctgaggaacaggcaacggggctatggtgcagacgtaatgaagagatgattctgtgcaagaatggaccatccatgatgattgattggatgtggggctaagggaggggaagggataaagagaactaggaggctgaagcttagaagaattggtggccagccatgccttctgctgagctagggacccaggagaggatgagatataggtagcagcaaggaagaagctgaattccattctggccataatgagttgaatgaaccttgcagtttccaggtagaaaagtctagaaggcaagagatagttatttcggacatcttggcttattgctgctaccgaaagccacaggaaaagcaggaggatgaaaaaaatgggaccctgagaattaagaagtgaacgaaatacccaggtgtcaaggaaagctagggaggagggatcaagcttgagaggatggtcagcagcgtgggtggtgctgggaagttaaagaggctgaagactgagcaaggaaatgtccctgaaatctaacactgaacacccactttataactggccttgtgctgggggtaagggccaccgtggtagacagtctatccaagagcctttccagagctcctgatctagctaagggaaagaaccacagttgatgccagctgagctaagcggccccagggaagctgcagcacagcctatttggcagtacacttgtgcccagcgtggattttcataccctgctcatggacttgtgtcctttcttcatcctcccttccatattcttccttgatggcgctcttctcaaccatagattttcttagaccttttgggggcccttccagcttctgacccagacagtgctagccaggccgtgggcactacaggtttgttgagtggttttgatgggagcggattagaggaaaaaccaaagatgaatgctgagcaagatgataggagcagggttgtgggaaggagagtgcctcctcagccagccagtgccttcccaggtggtcaagcactttctccttggatcctcaacaagcctgttgagtccagcaaggtctcccaatatccccattccccattttgtatagggaagcccaaagtttcagacagggaaaggggcattctgaagatgcacagcaagttagggacagcatccttttcctcaatggccttctactctcttggaataatgttgagtggcctgaactccttgcctctgtactggctgggaacactggatgtactcctttcctatgactgctgtatcagattaccaccagttgagtggcttaaaacaatgcaaatgtattatcttatagttgtgggggccagaaccccaaaatcagcttcactgggctaaagtccaggagttggaagctctgaggcttctggaggctccgagggaggagttccattttctttcctcttttgagcttctggtggccgcttgttttccttagcttgtggccccttcttccatctttgaagcacattactccaatctctgcttctatggtcacatttcctgctcttcttctgtagtaaaatctccctctgactttctcttatgaggacacttgtgattacacttagggcccacccagataacccaggataatctccacatttaaagatctttaacttaattgcatttgcaaagtcccttttgccatataaggtaagaagagtaacaggtctcaggggttagaatgtggacatgaagctggctaagagaggcaagcccttgggtaaagcgtcacctcacaaaagaccctgcttggcttcagtaggctgaggaccttgaggaaactctgctagatcactacagccctgtctgccagaactatccagatcgttcactgggctggtttggcaccagctagtgattgtgaaaactgaacagaagtcaccaataggatggtgccaacttagtgctagaaaatgtgggaggatcggcagggcaggttcacaaaggcccgagaatccagcggcccaggtgagcaagtgcctgtcccagcactgcctccaggctcgggactggggcttccaatcctgggtctggacttcaggtcctgcaggggagggactcagacttacacatcctctttgtaccttgtttgctgctgggattagaatttaggggagtgaagttcagggacgaatctaaggcctcccagccaaaggccatctagccacagcccaaacaaaggggcttccaacatggtcctaggtggcactgagaccaagcctgcagagactgggccctgtgagagaggcaaggcaaggccccagggcactgcaggctgttcaggtgagggcacctcatgccactgtggaaccaggagctcccaaggtccctgttctgtcagcatgagtgtctgattgctcccttcttcaaagccggctctggctcggaacgctgggtgctgagacactgcctttggtgagcatgggctgcttaggagctttagagggactcctgctgaactggggggcctctctctgcaatgccttctgccctgtctgcctgcctgactcccacatgtatctctatgggctagtagcctggtcgagtgaggctccctctgtgcctgtccagtttggcaccagctaatgattgtgtccaggggctctggacctgcctctttctagaccaaggagtcctcaaaggcagggtctgctgggagcctccctgtgacccctgcagtaccagcacaggcattcgtgccatgagttgaatagaactgaagagaagggagaagcttcccgggggtgggcaagaggaggcttgagagcccaggaataatgataaaacagtaacggcccagggctaaaggaatcctccagaatccgagttctgtggatctaagttggcctgggactgcctgaggatggggcaggccctgcccagagccctcttggagccagcctccagcacctcctcagcctgaccttccaccttcagtgtttagagctgagagagcaggctacggggcacataggtcagccctgcattgcttacacaagtgggccaagactccaagaggggctgagatttggccaaggtctttgaagaaggaatgcccattcatgaaagaagagctattacaacttctgtctcttcccagagtcttctttccagctcttcctagaaaagcatggcctgctcagtcattctcaggttcctgtgctgagaacaggagtgaggaagggaagctcacaggaatgaagcacccactggccactggagatcagatgggcaccattatatgttggatagtattcctccaaaaaatatgttgaagtcccaacacccagtgcctgtgaatgtgaccttattgggaaggagaacatttgtagatataatcaagttaatatgagatcattagagtgggcactaatccaacatgatggtgtcctcataaggagagacagagacacagacacacgtgggaagacagtcacatggagatggaggcagagacgagtgatgcagccacaagtcaagaacacctggggctaccagaagctggaggagacaaggatcctcctctactcctgaaggagcgtggccctgctgataccttgttcttagacttctggccccagaactgggagataattcatttctgttgtttccagccacccaatttgtggtactttgttccagctatcctagcaaagtcatacagacactttcacaaatgtctcacaacagcctctcagccaggcagagatggcagcattggctccgtcttctcattctaatgtcaactccttgcattacctctccaggcttgccaccgccccaactgtgaataaacagtgctcctcatcttcaaagccctttggaaatactaattaactctcagctaattggatgaaagaacgtgaagctctgatgacatcatctccattctgtgcccagatctagccacaagcgaaatctgggactgctgggctatgagccttgtcttgtgggaacatgttgtgcccacgaaacatggctggggacggccgtctactcactttagctccatgggcttcagaaaacggccagctgtgggcacacttggccaatcaagcacgcataacacaaacagtttctgtgattaagagtttgtgtgggtgtgggtgtgtgtgtgcgtgtgtgttaatcacatacctttgcactctgcacatcactgagattgtcttattggccgttctaaacagaagcttacaaaaacatgtgtactttcaaatctcctcagaatgcatccctgtgatcctgagggcctgtgtaccccctgccttgtagaaccaagaagaatccctctgcgtccagggccccagggggtgagcatcagttgagctgggcaagtagctgcgtgcaaggcctggaggcaagagcctgcaagtcggaggccatctgagccaggagccagagctgagagagattccgaccaaggccagaagggcgtgaggaggaggtgcagggctggggctgtccccacgacagcagggtctttggtggacagacagcaggcatgctgcagtggacagggtcaggagacgagggttagaatcctgcctttgactttgccactcattaacctggacaacagtgacaggcccattccaggtctccctgactccgtgcgatctctccttcatcctccaccctgtggccaggagcaccatccatgcaccaggcagatctgctcctggcactgaccactaaaaacctcacccgtgtgtcccacgggatggacttgaacatgatgggtagtacaatgaccgtctttgttcaataacaaagaaagaaagaaaggccattcctgctcagttatctttcaatccttcagatcatgaaaaaagatcaaaaaaactaaaaaaaaccccaaaacctcagagttccatgctctcgtgttttttgactttgtattgaagcataatatacattttgaaaagtgcatgtcatacataagtataacgcttgatgactgcccacaaggagaacatatccatgtcaaagcacccaaaccgagaaacaagatggccactaccctgacatctaggagcagaaattagtttcacccatttttctgttttatttaaaagaaatcggccgggtgtggtggctcacacctgtattcccagcactttgggaggccgaggacggtggatcacctgaggtcaggagttcaagaccagcctggccaacatggcgaaaccctgtctctactaaaaatacaaaaattagctgggtgtggtggtatgtgcctgtaatcccagctacttgggaggtcaaggcacaagaatcacttgaacctgggaggcagaggttgcagtgagcagaggtcgtgccactgtaaatccagcctgggcgacagagtgaaactctgtctcaaaaaataaaaataaaaaataaaaacaagaaatcactctatatgtgctcttaggtgtttagctttcttccctcgacattatgtttgtgagctgcatccatttgtttctacactcattgtcattgctgtagagcattacattgtgtgaagacaccataaattacttgttccttctaccttaatgggcattagggttgcttttggctataacaaatagtcctgctctgagtatttcttgggtacatgtttttaaaaacatccgtaggctgttgagtgggaacctgaaagtgggattactaagtcagaaagtatgtgtgtatttggcttcagtgggtaagctgagtttcccaagtggttgtaccaatgtaccctccccaccagtaaaatatgagtattctagttgccaacaatcagtattttctgtcttcttaattttattttattatgttatgtatgtatgtatttatttatttctttttagagacagggtctcactctgttgctcatgctgcagtgcagtggtgcgatctcgggtcactgcagcctccaactcttgggctcaagcgattctcccaccttagcctcctgaatagctgggacaacaggcgtgcttcaccatgcctggctacttttttattttctagttttttgtagagaggagggtctcgctgtgtttcccaggctgttctcaaactcctgcactcaagcaatcctcccacctcggcctcccaaaatgctgggatcacaggtgagtgccactgtgcccggcctggagttgtttatttgtttgatgtattctggatgagggttttgttgaagatgtgtatggtgaagatctcccacatgttgagtatcctttcactttcttaacagtgtgttttgatgaacagaagtttctcactttaatatggttcaatttatcacatttttggtcacactcagcacttttcgtgtcacacttaagaaatctttggctgttgccagttcacaaagacactctcctatgtttttcttctaaaagctttattgttttacctttcacatttaggtctgcagtttgtgtggaactgatttttttatatgatgtgtagtaaggattcatagacatttttttttcccatatgggaacccaattaacccagcactttttgttgaaaggccaatcctattcctactgccctgccctgtggtgctagtgtatctttagcttctcaaacacttgataactctctgatttgctgttgtaagtgttaatgagttaaaacagttcagaccccagttatcaatcaagcacttatctaggtggtgttgtgaaggtggtttgcagatgtgattaaagtctttcataattgactttaagtatggagattgtcctagatcacctgtgcaagcctcagccaatcagttgaaaggatttaagagcaaagctgagactgccctgaggaagaagaaattctgtctgtggattgcagcttgggcccacgtccaagagttcctgcatgcccttcctgacgacctgccttatggattttggacctccccagtcagcccccaccaccacataagccaattctttctcatagatctcttaatatgtatctcctactggttttctttctctgatggaaccctgtctgatacatgcctccatctcccaaacaagaccgaaatggtttcaatagtaaattcactagccattcaccgcagactaggcgaagagggaaccctcactaatgggaatggaatggaggaggaaaatgagtctaatctcaatcatgaacatagatttaaaaaagaaaaaactctacaaaatcttagccaagtattcaaaggatcttatgccatgaccgagttcatgttggtatacactgcaattgcaaaccaagtcttgccaggccaactcatcttaatggaaatgatgaaattcagttgagaacagtggcaggccaacagtgaaacttttgaatgaaatgcactttaattcaatgtcctcatccttgaatgtcttcatatctttattatccttggtactttcatgccccaggacccaaagctgagaaaccagcttgaggaagcatcctgggcccacaactgatttggttccacccctacatctctctcctaaaactccctttctcactgtgtccacctcactcagaagcagtagtcctcagtccttggagcacacctgagtctgcagggatacctgttaaaaatgtgagctgtctcctggggcaggttagttgacctagtggactcacgtctctgaaaggttccagctgacttgcactggtatctaggctcacccactttccagctgtatggccttgggcaaatgatctccctgctctgaggttcagcatcctcccgtgaaccacatagcctccctagcccaaaggggagggaagagtcacagctcctttgcccaccatgcagggtgccgcatggtggtaagggcagcagccagtggggagcaagggaagatatcctttgggcagcctgagtccaggaaacacagctctgcctcgctcagccccagaaggagccacacatctgccaggatctcagcagggtcaacaggagcagccaggctgagctcacatctccctgaaagaaagacagccgtggggcgtttcctgctggggacaggtggagtgaagtccttgctctccttgcaagcagccgaacattcaaagcgaggctgacaagttcaagtcatcctctgatccttctagaaatatcctgctaaaagccaatcacatgttttctttcaaatgtgtcattttgcacagatgtttaaactctggcataagcagcaggttgcatcagcctctcttacatctaaggcctgcaggatcccaataatttaatgttgaccaaaggaagaaagcctccttacaaagtggcagaaagaagaggatcaagacctcaaggagggttttctcaggacacctactgacagaagcactgtgcatcatacctagcatgtagtaagccctcaacaaatattagctttattattagcattgttagcacagctcccacgaacagtccccgatgccgcatgtaagtggctaactgagcaatttgaacccagtggggtaataatcttggaagttaagagtccgggctctagagtaagacagcctaggtccaaatcccagctccaccactcactagcccttccgtgccatagagtcctcatctgtaaaatggggataataatagtatttacgtcatagggctgtagcaaggatggaatgagatgttttcagtagagcgcttgggacagcacctgacataaaaagcattaagtcaacatggaccctcaaatcacccccttcagctgagctttgtcaaatcggccttgcccatctattaacagaatcttgagcaagtttccgaagttactggtgtcttgcagttgttaaaactcagaccagattaaaatgtcaatctcagactcagtttcactcttccctgagcccctggctgctctgagaccctcctgccgccctaccctgtttgggaaaatcaaaggacactggctgtctcatgggaagggggaggagtgggggaaatacatgagcccttttgaaggctctttgagacttgagtaggtttctgctccttgcctcagaggcatcttaacaaaggtgactcctgacaccttcctgtaggctctttttgcgtgggggatctctttgaggggagctggttggagctccttcctggccttctctgatcatccaacacacactcaaccattcccatactgcctaggtgatgtcatgccctcccgtggcctcaaggggccatcgctagctgcctctgcccctacaagcttggcctctaccctggacggttcctctgagctcctcccctgtggtgtcctggtgtcagctcatcttatccactcggttgccatacaggccccacagcctcactgtctcccaagtgaaaatcagatctctatcctattcccttcccccaactgttacccgtggagtctctaattcctgaataaaagatctgtgcaagtaactgaggccagcaggcccctctgtctctccttcccagcccagactctctttgggcaaagctcattcctggctattatgcacaccaaacaccagtccttcaatttggggctggggcaaacagtttaactctccagtcttaggaggagaggtctcccttgtcgaagatgggagtggaggccagagaacggggagatgaaagtatatcccagccacgtaggaacatttctgctggtgcaagaaacctacatcaaagtggccacaagatgagctaatagaaggtggataaatatgagtccatgtttactgcactttatgtggaatcttgaccatgtagggagggaagggcctgcctgcgccattctcctgctcccacccctttttcccaagctgagcaggagcccccttgggtcttggggttgactttatagcatttgagattcttatctcttccttctagtcttttgaagtacatgatgacactctctccttcctctgccttttcctctggggaaatataagaaaggaataaagacttatttgtctggaaaaaaaccaagtccaacttttacaagtagagaataaactacaaacaacttcaatctgatggttgactttcactgacaagaaatttcctcctttcctctccatccccatctctccttccttccctctttttctaaacatctagcagcctccttaactgccctgtaggcatagccctggctaatacctgtgactggaggagctctcatccacccaaggtagacatcatttcaccatgccaggatgcaagctgtaggcgaggcctgaggctcaacagatcttggaatccccctctaaatgggtatggtctctgcagaattcaggctccccttctagtctattcttctgaggaccatctctttctatttttccgtcaacaccctctgcccctcctctgactccctctcccatcaccgctactcctccatcctctggctaccagtttttgcctcagtactaggtggctttttaccagactgaacccctcagggtccaggcctggctcaaagcaggtgctcaggacacaagtatgggccactggaagccctgtatcgtggggagggagcagggagtagggcttcaggaagtgtctgcaggagtgacttcatacaatccactacgattctgatattttaaaacaaataatatgtgtgactttttaaaatgtcatgtaaaaacacgatttaacttgtctttaaaatataccaggtatttaccaggttcgtacttgtgaacaaatattgtcttcatccaaacgttaagaatggctaaatgccatcatgttccctcctccaaagctaccctcttggaaaagacaaacttgtccaaagaggctgccttagtctagaacccaaaggacttgtcacctccataatttggagacacagcatgagcaagcttcgcctgccaccccacagccccgccccgagcctggcatactgggccattgcagattgggtggcaatactggcagacatctagttctaaaccttgagtttagaaacatgggcacttgcaaatggcatctctggtttctttctgtcctggaaacgatcatcgtctgttccctccaatgctcactgagcatttggtgcgtgccagcccccatacctgttacctaagactcagggaggaatataagctggtttctgccttctagagctcacgggctgtcaggtagacagaggaaaacccagtcaccaccacatgatgtgctcatgaagggactgagccacgtgcgttggcttggcagtccccagtagctcagaagggctgccatggggaggaagcattttcttccggtggtctttgagaaacaacctctctacactgacaccaagtacagcagcacctgcctgtgtcccttcacctgagtgaagtctttgtttgtctttgtttgttttaggtaaaattaattctttctcagttcagagtggcccctgattctgccatacaagtgtgtagtagataagttcacgttcagtgtcgctacgcctttctgattttgcagtctttatttccttctagctctcacctttacagacttaaaaatgctccactggaaacataggttgtttgctattggagttttttggcctctgacacccctttggctccttgcttgtgctcctcaggtttctctgggccttctggggggctggcttctccttcccacctgctttatagggaagacacattgctcttggctcaaggcaccacccagaagcagaaggaactctctcctgggcagcccagtgactggcacgggctcaacagcttgaaagctccccagccagaggaggtctggcacagattgaacgggcttgttgggaagtacttgggggcctcagaatggctgagtgggctgggcccacagcagcaggggctggcagggctggcttaagtgttaagaataactcttttctgttgttgtttttattagtgcttttttattacgaaagtaatacactgccataaaaattcaaagagtacagaaaggaataaagagaaaactcaaagcatcttcccagtcagcccacacaaacccacttcctagaggcagcagttatgatcagtttcatgtgaaacctttaatataatttttatacatatgcaaatgtaacaaatataagaatgcattttttgcaaattgcttttctttaaaggaaaaaagtatatgcccattttttaaaaagtcaaacactacagaaaacacaaaataaaacataaaaaataaaaacaaggaaaagacagctctcaaaatccatatcttagaagatagcaagtgttgacactctggaaggtgtttctcaaagcctttgggcaatttgacagaagtgaaatcacactatttacgctgccatgtaacttgctttgatgcaaactgctatttctctctttcattcaacaatatattattggcatttttcatgcccctaactagagatctaaaatcaacacctcgattggccacatagtatcctgttataactttggaatggatcttctgatagaaacttatcttgtaacgagttttttaaaatatcatgaataatgttgcaatgagcatacaggtacttagttatctccccctgatgcagttactacctgaggataaatgcctagatgcgagggtactggcaatacaaccccaaaccacactgagctgacactttctatccactgcattgagaaaatagaacacatctgacaacaccaagtgttggcaaggatatgtagcactgggaattgtttaggcaggaaagtcagtgttctgctgtcagattgaacatgcacataccctgtgacccagcaattctgccccaggatatattatatagatggttcatgacttaacaatggcccgacttacgatttttccactctaccatgatgtgaaagcgatacacattcagtggaaaccaaacttgaagtcccatacaactattctgtttttcactttcagtgcagtattcaataagttacatgagatattgaacactttattataacgtaggtttcatgttaaatgattttgcccaactataggctagtgtaagcattctgagcacatttaaggtaggccgggcaaagctatgatgtttggtaggttaagtgtattaaatgcattttctacttagggtattctgaacttatgatgcagttacatcccgataaactcactccacatctgggaatgttaaatgctgctgacatgtccagtaaaatgcaaactgaaaactgatcattggatttagcaacatagagggggttgatgaccttgacaagagccatttctgtgtagtgatgggagtgaaagagaagggaggaagaggactctgagaaagtgtagagaattctctgaaggattgttgatgtaaagggaagaaggggaatgaatggacagtagctagaaaggtgtatggggtcaagagaaaggttttttaaaatggtgggaagaattccagcatgtgtgcatgctgagcagaatgatccggtcaagagggaataattgatggtgcaggagaaagggcgaaatgttagcaagatgttcctgggtaggcaacaaatgggatttagggcacaagcagaaaacctgacctttcatctgcttcaggacacatcgttctcttgtatcaggatggggcagaatgtgtagataatggtgctgtggaggtaggggatgaagatgtttatatgcatctcatttaatataatatatatatgtactatttttgtatgtcagataataaaaagaattttaaaatgttagcattgttgagtccaagggatacctcatcattcattttgtggcatatttttagatcaccacccagaaggttgccctgacttatcctcccactctcagagcccctggggcagaagagtgcccattttcccacacgccaggtaccccagggttttgcagatttgttttaagttttacatacctgaggcaggggtggaaacagttgactttctttgcatttccttcatatgctaattggtgacccgcaaatcttcttttgtgattatctgttcacttccttggtcctttgctgattttcctactgggttgctttaaaaggagtccttttttattttcggaagattaagcctttcgctgtcatatgcagttcaaataactcttcctcatttgtcatttgtctaatgacagttatggtgggttttgccatacagaagtttttaatttctccatcttttatggtttctggttttcatgacatacttagaaaggctgtccccaccccaggattctttctcatacttttatggtttcattttttttacattaaatttctgagccatctggagtttattttggtgtggagagtgaggtaggaaatctagcttctttttccaaatggccagttattccaacatcatctcttgaatgatacacttttaatccacagattcaaaatgccaccttgatcacacactgcatttgaaactacactctatccctccgttcatcaatttggcagctgcttcctgtgtgcctactcaggcatcatactagcatgaggtgtgtttcctacatccaggaggaagggagaggagacacaggagacagcgaccctgcagggtaataagtgctagggtggaaggcggtggaagagacacttagctgggtcttggtggttagggatgacttcttgtgaaggcaatgacctctgaacagacatgagcatagtagcagttaaccagtgcgagggaccgcagtcagcactaagttctagagacagaatggaggcctatgttgggaatcagcaggaagtccagtatggcttccatatgacaggagcttagagcgtgaagaggctggagccatagcaggtactagacttggatggcagagggaatgaggagtctcagatggtgcccctgtttctagcctggactgctggacatggagtcaccttatcacccaagcagggcagaggggaagatggctctggctgctttgcagaaagtagatgcaggagtcaagcgcagaagccaggagactgggaaggaggtgatcggggacactactgtgtcccaggatagtggcagtggaagtggatggtttggagctgcaatcaggactggctgctggattggacatgggagacgagggaaagatcagttaaacacctaggccttgggaggtgcctttgatgatgaagaaaactgagggaggagaggtttggaaggtgaaggatggtggcacaagagtttgttttgaacatgtttcatttggattgactcagacattcatgtggtgatttcaagtaacaaaagtagcaatagtaaacattcactgagcaccaccatgtaacaaactccattccaagcactttatgcacgccatcccatgtcatctcacaacaacctatgaaggtagatgctggcactctcatctctattgtacaggtaagaaatggaaactcagagagggcaagtaacgtgcccaaggtcacacagctattaattggcacagctgggatttgcacgcagtccagttccagagtctgtgctcatagccttcatgcctccagataagtgggtgtcagggaagccaagagaagcaagtttttccagaaggggaaagtggagtgatcaactgtggccacggggtaagtgaaggcagaaatgtgaacactgggtttagcaacatggagatgactggtgacaagaatgatgtgaagggagtggtagggttgaagtcctgatccgggtgagtttatgagagaatgggaggagaaggagagacagtgagtctagacaactcttttgaggagttttgctcaatagcaaagtggagagatggggcagtaactagaggtgggagtgtggtcaggtgagattcttttttttttttttttatgttgatgggaaagctccaaatgaaacagacatttttatgatgtagaagagaaagggataattataaagagggaagagtctatgaaggggagaaggagtggaatccagaagtttatattggcaccattctgcacagttgcgtgacgtctgccagcatggttctttgccttggggcaagcatgaagaatatagacatttagctttgtccagatttgatgccattatcatcaggtggaggtgacaaagagacagtagggtgagaagattaggatgttcacaagacagcggttgagtaagctggatagggagggaaatgaagagaggaaaggactaatggatggatagaaagtggagcagccaacagttgggagcttgaaagatagttgtcacagaagtggttgaacgagcctgctggaaagagaggaggttggggcaagaagttggaaagcctgcattctctattctggaggaagcaacagcaggcaggctgcacctgtgggaagaagcggctgtggtggagctgacagggtcttgggagatgcctggggagcctgagggttggggatagctaagccacaagcatggatgctcaagtcacacactcactaccacacctcactgctctcaccctcaccctcccagtcactttctcacatccagggcaaagacctgcctgaatgtcaggtgggggatggtgttgccagttggcctgggcctcaaagcggggaggttttcatccaatggcaaactggactattctgaggtagctggggtgtgggagaaggaagagcctcctctggattgagctgccgggagggtgcctggcttcagtttaggaggaagtggatagctccctccaagaagggcagcatacggggtggtgcaatcctagaactttctgtgatgatggacatgtccactatctgtgctgtccaacacagtagccactggccacatggggctattgagtacttgaaatgtggccagtgtgactgaggagcagaatttcctattttattcctttgtaattcactgaaatttaaatagccacatgtggccagtggcacctgcagtaatcagtggatttctagagacatgtgctggttacaggttacagagctgcagtccccaaggcctgggatgggacaggtcagggaagaaggagaggaggaacagacggcacaatgccaggaaggctagagttatttggtcgagttcaaggtctccaagtacaggttacttgggccaaatgcaatcaacaggagccaaatgcatcccccagccaggctggtccaatcctttttgatgagagccagccccttcccccatgctgagaaaattagagttttcatcaagtgaggctctgaccagcaccagcgtgggcagaagaaggagaaaagcagcaggtctgactccaaaggtcggggaccacagtcctgctcagttgaacaaaggggcaccctctgagctgttctcccctctaatctccaaaggctgctctccatgaggaaatcaaggcagctaagcacccagggaggtttctgggaaaaactaataaagaagcatacaccctttaagaggtgaaacccagtaacctttcctctcctgtgtgaagaggacttggatttgcaatggtgttttagggatccactgcatttcctcttcccaggtgggcatttcccaagccaagggcagtgcccagccgaaaggaacatggctgggcatggtggcttatgcctgtaatcccaggcataagcactttggggggccaagtcagatgagttgattgagaccaggagttcaagatcagcctgagcaagacggtgaaacctcatctctacaaaaaattagccaggcatgacggtgcgtgcctgcagtcccagctactaggcaggctgagatgggaggattgcttgagcccaggatgttgaggctgcagcgtgccttaattgtgccactgcactccagcctgggtggcagactgaaaaaaaagaaagaaagacagaaagaaacaaatccgcaactctcagagccagacataccctctggttgatgtagtttcagctccctcagccagtggtttagccaggccaggcttagcagggccccagagtcggagctccctccctcgcaggacagatctagctgctcggaagttagcgttcacctgcagcctgcatctctctgccagacctcccagcctggggccccagagaggtctgggcggggggtgctcacagaccccaacactgactctgaccttcccatttcttgagcatgtggcagcttccacacctttcctcttccaggcgcacactcacaatgcccactgagcaccagccctgccagagggtcctaggagcctgggctgcttctggggcagcagcagggcccctggggggcggggttgggcccagctctgggggaggagctcccagctgaggccaggcagcctccagagtctccaggctgaggaccgcgggggccctcggcacggcccctagccggcagtggctgagctgagcttggggggatgagggggcgctgggcagggagcccactgtctccttctcatggcttcccttcctccttatcccaggagcctccctgccggccaactgtactaaaactccggaaaaccatggcggggaggttttccaattagaacattctttttccgacctgtggatgattcttaaagcagcaaaaagccattcttcagggcatgcagggagtatctgccagcgaggccttggctccactcgcgcactcgtgctcaggaggcctggcctggggctgcttcagagccacagacaaaaggcagagcctgtgttgtggggcatcaggtcacacagaccaagactgatggctgagagtttcctgggctcattcgaaccagtagattcaaacggcagtggggatccaggctacaggagtggcagatgtcagaccacctctctccttgctttgtgacaaggccactgctcccaatgagaccactgttcacacagcaaacaatccccaggcatggctgctgtcccttggagtagaactgggctgcctcctcccccaaactgggagccgcaacaggccgggacagggtctgactggtctctggccagggttggggtggcagtgcagtggggcaagtaagaatgtgtgtgtgttccagagagggggaccacaaccccgtagcttggagtgcaggctgagaacagggggagaggagcagccactccacatgctgagaggctggaccagctcctagcaggagagctggttacaaacacaagggcctggcctcacgggttcggggctcaaaggacccatcctacctgcaatcacacctggggacccctgcctccagggcatccaccctgcttggagtcagcagagtcacccagcaagtgtaaaccggttgaagagcttaagaggatgaggtggcagggcgggccccgggaaggaggggattagggatcaagcaggagcccagccctccccgcacatgaacctgagcaccccagcttctctccagctgggcaggggctccatccagagcagctggaaccccaggttctaagcccagctctgcctcagactagctgtgtaatcctggcaacatcttgtccctctgtgggcctctgttttcccatttgtacaactgaagtgttgaggttgcctgcctgtcttcagtcccctctagctgaggacactgcctgggggagctttgcggcctgacagctttcagggcccaacccctctttctccccctctagcctggtaactctttttgttttctgtattttttgtagagacggggtctcaccatatcgctcaggctggtcttgaactcctgagctcaagcggtcttctctccttggcctcccaaaatgctgggattacaggcgtgagccactgtgcccacctcctagcctgggaactctggggctagatcaccttgcttgagttctcttcccagccctggagatcagaatggggcctcccctggagctgaggagtgctgctggccagttctttcccagcagccacctgccgtgctacccatctcattgcttagatgcagcctcccagagacgctgcctccacggcctgcttgtgagctatggcttctccagcacagggctcaccacctgctactccctgcctctacctttcagcctcttgcctgcccagacagcccagcctggccccaccctgaagcccctacctctcacttagagccttgctgagggcctgcttgttggtgggaagagactgtccagtcccctggaggtggcactgctgcctaagctggagggacttcaggagaactctgccagagccagggggtgggagctggcctgtcttggagctgcggatgggtggaaaagtgcaagagatgtgaataggaaaggatagggccaagctcaggccaggtagggacagagcccagcctggaggcaggcagcagccaccacagccttggcctagaacttgagggaggtctaagggaaggttcatgaaggagataatgttactgctgagagaaagtggaggccacctggtgtccctggggaggaaatgtcattccaaacaaagggagcatcttgtgcagcgtcctggtggtatttgagcacttggtctatctgggtacatgtcatttgggcatgtctggtgcttgaagaggctgaagaagccagcaggtgcctgaagcctggctgaggtgactagaggtgccctggcaggcgtggaagtggaagactgttggggcaatggacaggtgggcagggcagggcagggcagttaccattcaagtcaaacccgtttgcaggcaagatcagctgcagggcctggcagcctggcagggagggaggggttcagggaaggctgatctctttggctggagcagtcgtgacagatcgggcctgggcagagactgagtcacctgggacatgggaagagcttgaggccctggggcggcccagcctggggcagtcctcacttgctggccgtgccgttggacaccacatttgctcatgctctccagctgggccccccacccctgactcagggctcttgaacaagtttgccttttccctcttccttgccctacatctcacccatcatgatgtcttctaccttctaccctttcaaactaggggctcttgaagaggactgggacccagacaaagagtatgacacagcctaagtcatacagtaaacatgtttaggaggtaagatgccaagccaaatccatggccaccagtagccacagtggaggaggggaggtgttagttgctggccaccagacaggggcatacaatattggaagcagaaaaatgcttgttggcaagagacggacatgaacagaagtgactttatatacaaccccctaagcacacacagggtcgccttctccctatctcatgaaccccaagaagaaaaggatgaggacagcttccacagcctcactcacccatccatcacttccttctgcaaattcttcggatgccctgtgctggtctccgtgacccagtgatgaatcagaaggggccctgccctcccagagctcaggatctagaacaatagagggtgacagccactatgctggattgatgtcatctgagggaactaaggggtgcacagaaggaagtgatcagctcgactgggtggcaggcaggggaggctttccggacactgggtggaggcttgaagaatgactaagagctcactagcccgacggggatgaagagcattttagggagtccgaggagcaggagcaaacaccccaaggtgagcgccatgtgatgtattcagaaggcaatggaaaaaggccagtgtggctgtaatgtattgaacaaagggaagagtggctggacctgcagggataggtcgtctcaaggagtctggcttttaccctgagagcaatgggaagccatggaggagttgcaagcaggagagcacctgatcatattgacacacgtgaacttttaacctgacctccgtgtagagactgagggaaaggaaggcaagaccagaggcagggggacaccagcaaggaggctggtcttcggggccaggtctggactagggtggtggcagcaggcacagggagaagtgggtggactggagggccatggaaacaccacattggcaggccttgatgaaggagaagcagctggtccattcttttgagcctaccaccctggtaggccaactcctggccaagtccatgccatttcttgggctggcttaattgtctccctgtttgggaggccgtggggtgaggggtctttcctccatgctctctccatccttagccccagcccagggccttgcacacaataaagcactcggtgagcaccaacgcgtgacacaggtacatcaaaccgcattggctctgggagtctggctgtatctcgtcgcccagcctgggagatagccccgtttgctgtgccttgtgagccccgggtccgtcccaggatggccttccacgatgagcggctccctcactcttctcctcctttcctgcctgcaggacttcctggatgatctcagccgccagccccccgcccccctccccgcccctgtctgggatctccatctgtaaaatggatctaggaacggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaaggaattagctttggctgatgttagtcaagggcaagaaggagtgacttcctgtcactggcctgctctggcaaagactgaatggatggcagcagtggtgtgtgtgtaggcgggggtgttcctaggggagagcgaaagagggtaaaagaaagtggccgagtgcggtggctcacgcctgtaatcccagcactttgggaggctgaggtgggtggatcacttgaggtcaggagttcgagaccagcctggccaacatggtgaaaccccgtctctatcaaaaatacaaaaattagccaggtgtggtggcaggcgtctgtaatcccggccactagggaggctgaggcaggagaattgcttgaacctgggaggtggaggttgcagtgagccaagactatgccactgctactccagcctgggtgacagagcgagactcgtctcaaaaaaaaaaaaaaaaaaaaaaaaaaagaaaaggaaaaaaaagaaagaaagaaagtagggggagagggagaggtgctgtggagattggagtgtgggctccatgacctctgagcctcctctgatctcactggctgccttgtctgcaaatgggactagcatctctgcatgactgggattggctgaagaccacattggttccctggctgcagagacaactgcaggatgaggggtacagaagcagccagggccctacaagagggtccctgcccagccctctgttctccacagagacatctccaagggcccttgaagccaagccagccctgaaatggcccagttccctgaacggtcgcttgtatctggctctctgagaacgagaaaatgggcgcatgaaagccaggaggaatcccgaggccccaaggagcggtgggtggcccagctgccttctcccctcctcctcacccccagcgccccaccaccttgggaaggagctggcctgccttaaaagtctgcctcccagggcccctccagtgcagacgccgagaagtctagatgctggggtgttaggggtgggatggggagaggtgaaattccagactttcatgcagaagtcatttacctgtaaagcacatttacaaataccacccccgccatgcgttctttttccatattatattttcccctctgcaactcaagtctttttcagctctttttttttccacttgctgagcctttttcctgccaccctgttggcctccaggcgagagcccctgggactggagcatcccaggcaggtcgtgcactctggctctggcaagaggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccctctcaccccttggtgctggtgctggtggtccccaggttgagttggaccagaatggaggggtggagggactcccctccaggggactcccctcccctccagggactcccctccagagtccctcccctccagggactcccctccaggggagctacctgggctggctgggctctggggcttgggcagcctggagccttgggtttgtaaagcccaactctggctcttgtaggaggactggggggaaaggtgtagcagctggggtcacccttgcacatgtgtttttccatggtttggtcattgccacccttatcgagtggtagggaacccagacaccatgaggggagaaaggatttgcccagggcagcaaagctgggatgagtctccttcccagagaccagccatcttctctgagggttccagcaggcatgagccccagcaggtatctaagctgagggatcagcactgcctgggtccgcccatctctaggagcaagttcttgggagacaagggagttatcccttcaccacttacctcatgaccagatgggagtacttatgtttctgctggagtgatgggggcaggcctatgtgctggtccccagctatattctgggcctctgcctccattaaagctccttgtcccagagccacgtgaaagtgcttgcagacagagctttcctgaaacacagccagaggtttcctaaaacatagcaatcagcctctgcagtgggcagcccaagtcttgatggcttcatccacttgtacttgacagatccatatttggtccctgtacttgactgcaggggcagcactctgggctgtgtcccccttcttgccctgtccagctgtttctttatgctgactcctgacccaccccaaaggggtccacacagatctgagctgtgagtgatccctgtgagcctagctgaggttggcacacgtggggtggcagagctgggtgtctgctcagctcctggatgcaaagcatcccaattcacctttgggaaagaagcccttctgcttgcacctctgcctgtggcacacctgctcctgcttgtgcatggcgcccagtgcccagcacacatgcactgagacaagccctgacacctgtgccctctggctgcatctcatccatgagcagcgatattcagtgctccgggaaggcaaggctgaaggcgttttgctcccttgccctcccagtttgcttaggaggccctgcctggcgtcctacttcccttctgcacagtttgggagccatcctaatcccctgcgagccagcttctctgggaggtgccgccctcggggagtcaggcagcggggaagttctacaaaactttctctgagttagtcctctcatcttggaggctgagcacgtcctgtggtgtgagagggagtcttttctcctgccgctcccgtctgtgtccatctcctcacgctccagcacctgcgtcattgcctgctgccgcccccgctcctccagcgcacgggaatctgcatgcatcagccccctgcgtcagctcccctctcactccactcgctgatgacaccaggcttgctgtggtcgggataacaggctctgttcagccacctcattggctcctcgctcctatctatccaatcagggccaggggccccttccttcgaggttgctgggcaaccttcagaggccacagaggcagggagaaaggtagagcaggaacatgcccatgggcatttggaggccatctgaattcagggaaggcctgtcctcatctcccccgcccagccctgccagggacacttcctcagattgccatctctcagcccacttggccagagacaggaagagggagaaagaaggggatgaagggcgggccggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttagctcggcggaagttggaagggcatttcaggtgggcggaccagtataagctaaggcacaggcattcacttggcagggctaccttccagggactccaaggcacatggtctgcttggagcacagtgtcggcattggggggaaagaggctggctcaggggactggtgattttgctcccagtcttagaaacagtgtggaaccatcaggtgctgactgagaattgaaggctgatgtgggccaagtgggattagagaccaatgagtgttgcctggaggaggtgcagataaaggcagcaggccagggaccagggaggaggtctcaagggatcgtggcctagaccagggcaaattggagggagaagtcagctctgtagatgggatgtacattccaacctcatttgcccaccccacccaccccaccccgccccatcccatcccatcccatcccatcccatcccatcccatccctcccatcccaccccactacatctcatcccatcccatccatcccatcccatcccatcccatcccatcccatcacatccatcccatcccatcccatcccatccatctcatcccatcccatcccatcccatccatcccatcccattccatccatccatcccatcccatccatcccatcccatcccattccatccatccatcccatccatcccatcccatcccattcatcccatcccatcccatccatcccatctgatccgtccatcccatcccatccatcccatcccatccatcccatctatcccatctgatccgtctatcccatcccatccatcccatccatcccacccatcccatcccaccccatcccactgcctgacactcatcactttaaaggctccttgtcccaaagaactgccttacacttcatcgtgtggaaagactctactttggcagagatttttctgactctttcatatttattgtctcatcaaaaaagaaatttcacttgtgagactcagccaggcgtgagggaaaggagcccatgcagaagcaccagccctggtctttgtctggcaataaacccggagtcttctgactggagtctcagctataaagacgggactgaaggcagcatggtgccctctgcaggggacggatggtgttcccacccagccctgccctcctttgccatgggtccctctgcctctgtcattctgcatgtgcaaaagtgtctgtcttgactttggaagtggcttatttggtcctgatttggcaggaaacttctaggcaatgtggccatcaggtttgacaaggggtaactgatgagtccttgtgcctggtactgggcctgggatggagtccacccccgaaactgtggatgaccgtcacctgcttgccacgctcatatgtggaagctggtggctacagtccctgaggccttagaaaggagtacgtctttgaggtgcccagcgcaaaataagtcatactagctagtacagcctagcaaggttagaaggaacctaaagacgaaagactaggaggtcctcctgcaggtgaaaagctgaggcccagatgaagtgaggaactgtcccaaggtctgtagtcagtcagtggcacccagagactctgcacatgtgccctgcccatggggccactccacaggttgctgggatggggacagttaggcctgtatggccctaggaacacctgtggagtgagcgccactcaacagaactctaacgtggcagctttggtgcagggctgggcacgcggggctcccatttgcagtgatgaggtgccattcctggcacacagcaggctcgggctgtctgggctgctcgttcagtgcagtttatggaagagccagctcttgctgatgtggcaaatttggtttgctctcgtccccctgccctgcccatttgagtgtgcccctgacctccacagaaacacatccaggccctgccagctggcagcagtgctgagctggtcagaccctagccctggaggggcccaggggatgaaaggccctggagagaaaggctcttctgctttgtgactatgccagcacaaccagggccctgcttcctgtcatgcccacaagcctgagcccccagcccctattttgaggcccaagggttcggctgtggccactcagggctccctgcagctctgggtcgctcccagcctggagagccagcttcatcaccctgggcccttctccggagcaaatggccctcgagaccaccacagctcacccctcatgggcacgagagggcagcactgggctcaagggcagagaggctgaaggcagtgtggcaccgtctgggcagcatgagcagcaccgggctcaggggtagagcagggcgagaagacacagaggaagaggaagcagagctcaaggcagctgtgggccagggcgtaaggaagcctaacttaccacattgccacactcgcctgttccctgagggccactaggatttggcagtggggccctgggctttccccactgaaggtggagccaacccccgaaggaaacagggctgcacaccccagaccattcttggcgctgtttgaggaccaccgcgcctctcctagcagatgacttgagagctactgctgcttggctccttttcaggtggtgccgggtacttataggagcatcggcgcattccatcctcacagcagtcctgaaaggtagaattttttttttaactatcattttacaaatgatgaaactgaggcagctcggagaggttagctgacctgcccaaggtctgtcagaaaactcctaaggggtgagaagcaaggtccaaccccaaagcagctggtcccccagcccgtccctctccacaggccatctgcctgccctgaagctgttcggctttggatgcactctctcccaccctctgagtccaccagtgccagctgtcttccccacaccccccagcctgagccaggctgttagcactctgtaggagggctcatgttctcccgttatcagtgatcgctttgaacagacagtccctggcagcccctgagctccacattctctaggtgagcagccctgggcaggcaggtgggtgtgccgctgggcagcagcaggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgt

SEQ ID NO: 639 - DNA, 486432 bp, Homo sapiens
ccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggacacgtgtaaggcgaaacgggaacacctaaaaagcaactctccctccaccaggtgatccctccatctgaactacaatggcaaatggcacccttcccctacccaatggtttagatgtaaccagtgtctttagagatcttaaaagggagagaattcgggtctttttattggaccaaacttgttctaccaggtgtttaaactcaatctgctaaatatggcttgataccttgtactcaagcatcagtcgcgatgatctgttaatcacatatgttactcataacaaggattcttcttcccattaccatattatatctcatataaggcagtggaagttcaggggaccaaaactcacaaggagggaaaaggatgcattaatttggcagctgcagaagaggcagaaagtggaagaatgggaagagaggaagagaagggtcaggagagaaacaggaagaaagcagaaaagaaagaaatggcatgaataaaattgcttgtatttcagtcaatattttaggaatatttaagatcttccaagatctctatagaagccccgctgtgatgatctttgctaacagtggaactcctcctttctctcatcctgtcttataaagaaaatagcatcaggaaatgaaaattcctaaatctagtgcccccaagggaaataggacatttatatgcttttgatgaaatacagcatctttaactgaaagctgtgtgtcctagatgaaagaccagcaaagccagcataaatttaagagtagaaatctagcaatgcaagtgaacttggctaggaggaccacaggcactggatgctggtgattaagacttgggactatgatttaaacatttccctgatttccaaaagatgataaaaaactatgacatgtccagtggctggacttttttttttttgtctttatttctatttaaagccaaaagaaagcaacattgaacaggaatgatttctcactagcttctcaccatctacataattgttatcaacaaatataaagtccagtattttttaaaaaatgtaattctgggaagatttgattcaaatcagctactaacccaagtggccatttagacttgtatattgcttcctagtccaaagattcaaccatgggactctgatgcccactatataaatagtgtccagtggcccccaaatcacacctgtagcaatcacacatgtcacattcctgtcaaaagtttattttatgatactaaaagataattcttcagtagtatattgattgaaacagttcagccttgctaaacatgatgcttttatctatttaaatatgccgtgtctcccaaccttccacagctgctcgaaggccagcagacgcaaaatctatcattttccactgtgaactgtttctgcccttgcccccagtcatttcttactcattttgttattttgcaacatatgtattttaattcactaacaagagtcgtgattattcgttttaaaaatatcaagtagagcttcaaaaagaaaaggaaaatcatccacacagtatgttttcaggactgcaggtccatattctgaatttgacatttcatagtgttagcatggaaagagcactggattaggagttaggaaatccgtactgcatttttgatgccaccatttactggttacatcacattagttactgagtctttccctgaggcactgtggcttcctttataaaatactcatgtttctatctttcctaacaatcccacagggtagaaaggatatcatgcaatatttaatgttggtgttctttaaaatatgtcaactgctccctgacatgaaggcgttatgtctcttctctcatacaggtctaacatattcaagctgatcaccatgcacaatacattcagttgccttccatctaaaagatacgtagaacattgcattgttttccaataccctcatatattgtgttaatctatcctttcctccccaaataaatggtagatgcctgaaggggacaagagtcaagtcttcattcctacttcctctagtgtccagcatatgtgaaacatatctagtctcttagtacttacagtcagttctcattattcacagtagctgtggcaaataaagtccctgtgaacactgaattagcaaatactgaaccattgctcccatggggaaatacagggctatgttcctgcaaacctctgatcacattttcatcactgaatcaatccattgccttgttttatgtgtttctgaatgataatgacaccttccttaatacataatgttgattcatcaacattgaactcatgaccagcagcactctaactcatgcctaaaagaaacatatctaatatgtattttctccataaggcacatcacatctttcttgcatttaggaacattagacagccctttagtattatgcttgagggccattttaaacagcaaagtcaccaacgtaaaacacaaaaacgtggtgctaaaaagacctaaaatagcgcacttgtttacagtgtgagagctgaaacaagaaggaagccaatagtcttgttcaacttcagccaggaacatgtgcattgggaacacaaacgtttgccattctctgcgtgtttgctaaggatcatcaaagtgccagggctacaaataaataacaaggatcaactgtatttgttattctcttgattgctaggaatggataaggctgggactttggagagcgatttgtataaggaaaagccatagaaatagaataagcgtagaagattgtgaataaccttcccaagagcattcaattaggaagatgcttcccctcctccctcactcccctgcctgtcttatattgtctggggccttgggagataaaggcagggttagagaaaggatgggccagaaatcttagttttacaggagtctcaagagctaaagagaaaatatttatggctgcctcaaaagaagaaattgtagctgtagtcttccaggcagatgtctagggcacctttgcaatacttaggaggttctagggtgtatgctgtgatacggatacagcaatatttgttataaatgattgtaattttgtggaacaaggagcaattctctgtctagatagtgtagaaaaagtattgtgggcaaaaacatgagtaatctggatgaagcaaataaagcttgtgtgtacccattaatttgtgtctcttcagctactcagtctttgggcttgcaattttgttatctaagggaaactgaggcagaatctcacaaattgttctcaggtgattgaagaactggttggaggaaacatggtttttggctaactgtaatgtattctaaaaaaattcagcacagacagtgcgatgtaagtgtttcttaacgctgtctgtaccccaagagtgtcagtgcctttatcaggaatttatgccccaacacctcagtcagaattacagcagacagaggtggcttctagaagccttgtgctactatcatctctaattatgatgtggctgtgctcattagttataatatctgttgaaaataagttatcactgatgaaattaagggcttgttaattggtccaacgaaagttaggaggaagttaatcctttgtgaaattattaataggcaagatgcgtgaattaactaaattttacctgaacacgcctcacttctacataaacagagtatgtgactctaagaggcttttcaccctttattatgaggaatggttccataataatagtaataataaaaactaacacttatttctagcacactactctgagtgatttaaatgaattaattcatataatcattacaaaatgatatgaggtaggtactattgttgatccctaacagttcttagtcacttaattctgagagatggtgaggtgggtgctgtcgttgaaatactgtcatatttgcttcaggaaaaccatttttggaagacatttttttcaggtacttaaaagaatgaagagctggaacttcaccaagcttctagaataggctacaaaattttgtgcctactcattaataaatgtctagatctgtagcagaagttggtcttggtgttgaattcattatgagctgtacttgtgtgaactcttggaaacggggttcacactcagttgccgccaacaaccatggctactgagatctacctaaaagaacctaaggactgtatgtgctaagctgtcctaagcccactcacgcctgatgatttatcatgaacaagaatacagggagcctacgttgaacaacagttaagaaatgagacatggatttgaaagttgagaggaaaacacaaaagaaatagaaagagatggaagaggagagtgagtggaagagggagattctggagaaatgggaaaggacaggccatttcaagttatttcttcatattacaaaaatcaacctttttgtctcaaaaaacaggatggttgtcaggcagacactttcattcttttcatattttccttaagcttaattggaaacccttaaagctcagtattaagctttttaaatagaaaagtagacactaaaatcagcagaggggaaatatattaaaacccacaggcagcactaatattttaaaaattaaaaatgagaagagtgtcggtcttgcattttgcatttctaccagtatccccataaagtaaagataagcagaccccacatatccatctacctacttttctgagtttgaactgagcgtcagtaaaaagggacagactcagaagagggtttgttctggagagctgtaaagctaaacccctgatcctgttacccctctggattattgcaggtccctaagagtaagatcagaaaatgagagtaagagcattgataataataataataataataatattataataataataataataataataataatgccaggctaaaagcatctctggagatttactgcaatctttttattattcagatgataaacttgtgttacagaaaagtcaggtttatttatgaagtgtttatttatcttgaggaacactttcacctccaaccaccgatagtccagtcatagatatagattggtgaattcagtcaacttagctattacctagcacctccccaatgatataacaaatcagagggagtgctggggatcaagatgagccaatgcggtactcaagtcactcaaattgaattaaagcctagatgtgcagtttgacttggaaacgtgactagatttattcaagtcaagattggttgtgtttagctctgaaatattctgtaatctctatcttgtctttcattcgatttaataaaaatttcatgtttggtggcttgcatacaacttggtgcttaagtaccaagtcagggtcatagagatttcactataactgcaagttcaagtgttgcaggcatcacaggagcaccaaccaataatatgccatcttttaatcactgtcagcttatatagtttgtagaattgtttcaaccgatttctgttggtgacaaacacttcctaggctcatgctctttcagtttcaatgtgttcataatgtagcgtgacaacatgagactggagtgcctgactgtgagtatgaatccaagcttcattgtttttattcatgtgacattgagtttaagggccccttgtcccagtttcctcatctggaaaatgattataacgctaaatgtaatgaaattggaaccatttctaaaatctattaaacacacaataaatatgttattattctttattcatgtgtacttagtttagcttatttattctttattcataggtactttatgccaaagacataaagataatgagctgcgatgtggtttttaatttggccatattctaaagtcttcccactcagtctatagtcaagctcagccacttcttaatttattaccatagcctctgtttctctaaatctgtgttgctcaaactttagtgtgcatagaacatacactagaggggctagaagggctgttaaatcacagattgctttgcttttgatttccttaatctttggaggaccctgataatttgcatttctaacaagctcccaggtgatgctgaagctgctagtccaggggaatgccaaggtccttatttcaggttttattaactaacacatggagagctttctcattaagctccttaccaatgatctcacctcccgttagttgatccaatataactacaggcagatcagtgttccctaagcatagatcatagtgctgttcccagttctcttctttaaagcattctttaaaaacttcaagatgtctattatataaacctatttgttctcatctcacaccatgtaactataaattctctttactacagttagaaaaaaatattctattttccttctcatcttttgtatttgagctcttttatttgttgccttaccagtggctatgagcaggaactcagacactacactagggttcaattcttgcttctacaaacttgctagctatgtggccttgggcaggttatttaagctcagttttcccatctgtaaaaaaggttaattgtagggttgttgtgaggattaaatgagtcgacaaatttaaagcatttaaaatacaatagtgcctagagtatatgtgtgtgtatctatatatacactaccttagcgtctagagtgcatacatatatatatatatatatatatatatatatatacacacacacactagctttttgctgttgttttctgaaatgggttttttttccccttgttttatggtagggagaaaataaatcagaatttatgataatattgttacatataattcctaatactggtcatccaaatagtcaccataacaaaactaaactaaacaagaacaaaaattaaaaagtcccttccaggtctgggcatattaggcctccagtccaaccagcatcagctagagaaaagatcaatgccatgaactggcaacctgggatctgtgtgcctgaattccaagacactgtctgtcatacacatctaccactgcagaaagaagcatgagattgttgagaacaactagaagtggaaggacaactctaaggcaatttagggtaatattaagactaaagcataatttccaaattctttggtaaacacagatactcaaaccaggaaccagaaatcatgtaccatatgtttaatttcctgaatgtccaaggactcagagcataaaacaatttgatttatctttgtgaatatatgttgtagagcatatactacaatttgaatgcactgagaggaacttaatcatgcgattcaaattgagtctctatctgggatctataatctaatccccacccaattcagaaattcaggatatataaattatatatatatacatatatatacacatatatacaatatttatatatacatatatatatatttgttaggttacacattttgtcagagatattctgatgtcaatactatagataagttggtatgactattctactatcaagacctttttaccaggtaaaattaaaattctgtagcatgttatattaagccctttaaaatgtgcctccatgcctcttgttttacctccatttcaacttctgccactttccccacaaacaccccaggctccagccacatgaatttctcactcttccataaaacacactgcacactttttgttgttgttgtttttactttgacatatcccatgctattctctctgtaaaactatcttttctacttccttcgtctcttagtattgcattaattgttctatcaaatgttaatatatatttccccattggaaaaatttctgaactctgtcatttttttgctaccttctcaagtgtagaatattacaaatacctaaaaaaagagtgaggatatgtaacagtgtattcacattactattgtgcagaataaatgatgatcaaagcaactggttaagtctatcaccatgtttagtggttaaaatcaccaaagccaacagagaaatgaaacaaatcctcttcaacttacccttataggtttattggtgagttatttttattatctaaaatatataagaagtttaggcttaattttaatttgaatgctaagtaagctggttataaagaatgatggaattcattgtcatattttcctactcatgttataaacagatgtctttcttttccatacttcaaaaaaaaaaagaaagtactgccaagctaagatgcttgctgccaagttgaattacagaacaaacatttatagccaacttataaattcttaactgtagggttttataatggaaatactgtcaccattttcactataaccattcaaataatattactatagcaaaacttatcatctaatatttttttctgggatggatgagggaagactagctataagagttggaaaaacttctagtagctcaattcaaattgcacaattattccaatagttcaagtctcttagaatattgattttaaagtaagaagtatatgctccaaaacatttattcttaaaagataggaaattttttgatacctgtataagaaatatatgacctctgaggcattttgaaaaattattaatcaatgttgcttttctaaaactgtcttattttccttttgtaaaagaattactttccctcacattttctctgttctattgctgagatgattcccccggagaactgtgtgtttatcttgacaggtgttagtagatccaaagacctctgtggaattgttcctggttgcgttcaagtacagtagaaaacattatgcctgcaaagcaatgaacttaccttattgccttctaaataaaataaaccacacagcaagtggaattaatctactaatgtcttcctaatgaagctttcattagacatatggtgtggtcttcaatatttaacacgacaggtattaaaacaaagcatatctgatgatttttttaaagcatacttgatgactgcctcttacgttatttttaaatgaactagtttaccttcagattgctttaggcacctaatcaaagagatacaagaaaatatctagacttaagatttttttttaatcaaatagaagaaacaaatgcctcactaccaatgcccttaaatgatgaaaactgggccaggtgctcaggcctgaaatcttagcactttggaaggcgaagacagaaggatcactggagactaccagtttgagaccagcttgagcaacataaggagaccccatctctacaaaaaatttaaaaaaattttgtagaggcatggtggtatatatctgtggtgctagctaacataggaggatcactttaacccagttcaaggcagcagtgagtaatgataaggccactgtgctccagcctgggtgacagagagatcccatctctacataaacaaataaataatacatttatttatttatttatttttttttttatttattattttgagacaaagtttcactcttgttgcccaggatggagtgcaatggggcaatctcagctcaccacaacctctgcctcctgggttcagacgattctcctgcctcagcctcctgagtagctgggattacaagcatgtgccaccatgcccggctaattttgtatttttagtagagatggggtttctccatgttagtcaggctgatctcgaactcccaacctcaggtgatccactcacctcggcctcccaaagtgctgggattacaggcatgagctaccgcgcccaggcatatttttatttatttatgtgctattctcatattgaagggagaggcaaatttccgattttctgtgcagtgtaaaatttcatgcattaataaaatttataaggcaaatattaagaatgaaattgttttagcccaattcacagtggtttgcttcagaagtagcaaacactggattcccaggcaagatggccaaataggaacagctctggtctgcagctcctagcaagaccaattcagaaggcaggtgatttctgcattttcaactaaggtacctggttcatctcactgggactggttagacagtgggtgcagcccacggagagcgagccaaagcagggtggggcgtcacatgacccaggaagcacaaggagatggggaactccctctcctagccaagggaagccggtgagggactgtgccatgagggatggtgctatccagcccacgcactaggcttttcccatggtcttcaccaccgacagaccaggagattccctctggtgcctacaccacaagggacctgggtttcaagcacaaaactaggtggctgcttgggcagacaccaagctagctgcaggagtttttctttctaccccagtagtgcctcgaacgtcagcgagacagaaccattcactcccctggaaagggggatgaagccaggaagccaagtggtcttgctcagcgaatcccacccccctggagtccagcaagctaagatccactggcttgaaattcttgctgccagcacagcagcctgaagtcgacctgggatgctcaagcttggtgtggggagggacgtccaccattactgaggcttgagtaggtggttttcccctcacaatgtaaacaaagctcgtgggaagtttggactgggcagagcccaccacagcaccacaaagccgctatagccagactgcctctctagattcctgccctctgggcaggacatctctgaaaaaaagacagcagccccagtcaggaacttatagataaaactcccatctccctgggatagaacacatgggggaaggagcggctgttggcacagcttcagccaacttacccactcctgcctgctggctctgaaaagagcagcagatcttgcagcacatcgctggagctctgctaagggacagactgccttctcaagtgggtccctgatccccatgtctcctgatggggagacacctcccagcatgggttaacagacaactcatacaggagagctccagctggcatctggcaggtgtcccactgggacgaagcttccagaggtggaagcaagcagcaacctttactgttccacagcctccactggtgatacccaggcaaacagggtctggagcggaccccccagcaaactccagcagaactgcagaagactgttagaaggaaaagtaacagaaaggaaaacaaacagcaggaaaactaacaaacagaaagcaatagcatcaacatcaacagaaagaacgaccacgcaaaaactccatctgaagtttaccaacagcaaagaccaaaggtagacaaatccacaaagatgaagaaaaaccagtgcaaagaggctgagaatttcaaaaaccagaattcctcttctccttcaaaggaccacagccccctgcaagcaagggaacaaaactggacggcgaatgagtttgacgaattgacagaagtaggcttcagaaggtgggtaataacagactcctctgagctaaaggagcatgttctaacccaatgcaaggaagctaagaaccttgaaaaaaaggtagacaaattgctaattagaataaccagtttagagaagaacataaatgacctgatggagctgaaacacagagcacgagaacttcgtgaagcacacacaagtatcaatagccgaactatcaagcagaagaagggatatcagagattgacaatcaacttaacaaaataaagcatggagacaagattagagaaaaaagaatgaaaaggaacgaacaaagcctccaagatatatgggattatatgaaaagaccaaacctacatttgattggtctacctgaaagtgaaggggataatggaaccaagttggaaaacacacttcaggatattatccaggagaacttgcccaacccgcaagacaggcccacattcagattcaggaaatacagagaacaccacaaagatactcctcaagaagagcaaccccaaaacacataatcatcagattcaccaaggttgaaatgaaggaaaaaatgtcaagggcacgcagagagaaaggttgggctacccacaaatggaagcccatcacactaacagcagctctctctgcagaaaccctccaagccagaagagagtggggatcaatattcaacattcttaaagaaaagaattttcaacccagaatttcatattcagccaaaataagcttcataagtgaaggagaaataaaatcctttacagacaagcaaatgctgagggattttgtcaccaccaggcctgccttacaagagctcctgaaggaagcactaaatatggaaaggaaaaaccagttaccagtcactgtaatgtgaaagaccaatgtgtgtaaagaccattggcactatgaagaaactgcatcaactaatgggcaaagtaaccaactagcatcataatgacaggatcatttcaaacataacaatattaaccttaaatgtaaatgggccaaatgcccaaatcgaaaggcaagactggcaaattggatagagtcaagaccaatcggtgtgctgtattcaggagacccatctcatatacacagacacatataggctcaaaataaaatgatggaggaagatttaccaagcaaatggaaagcaagaaagcaagggttgcaatcttagtctctgataaaacagactttacaccaacaccaacaaacatcagaaaagagaaagaggggcattacgtaatggtaaaggaatcaatgcaacaagaacagctaactatcctaaatatatatgcacccaatacaagagcacccagatttataaagcaagttcttagagacctacaaagagacttagactcccacacaataataatgggagactttaacaccacactgtcaatattatacagatcaatgagacagaaaattaacaaggatattcaggacttgaactcagctctggaacaagcagacctaatcgacatctccagaactctccaccccaaatcaacagaatatacattcttctcagcaccacattgcccttattctaaaatttaccacataattggaagtaaaacactcctcggcaaatgcaaaagaacagaaatcataacaaacagtctctcagaccaccgtacaatcaaattagaactcagcattaagaaactcactcaaaaccgcacaactacacggaaactgaacaacctgctcctgaatgactactgagtaaataacgaaacgaaggcagaaataaagatgttctttgaaaccagtgagaacaaagacacagcgtaccagcatctctaggacacagctaaagcagtgtttacagggaaatttatagcacataatgcccacaggagaaagcaggaaagatctaaaatcaacaccctaacatcacaattaaaagaactaaagaagcaaggtcaaacaaattcaaaagctagcagaagacaagaaataactaagatcagagcagaactgaaggagatagagacacaaaaaaaccttcaaaaaatcaatgaaaacaggaggtgttttttgaaaagatcaacaaaatagatagaccactagccagactatatataagaaaagagagaagaatcaaatagacacaataaaaaaatgataaaggggatatcaccactgatcccacagatatacaaactaccatcaaagaacactataaacacctctatgcaaataaactagaaaatctagaagaaatggatacattcctggatatatacaccctccgaagactaaatcaggaagaagtcgaatccttgaagagaccaataacaagttctgaaattgaggcagtaatttaaaaaaagcccaggaccagatggattcacagcctaattctaccagaggtacaaagaggagctggtaccattccttctgaaactaatcctaacaatagaaaaagaggcactcctccctaactcattttatgaggccagcatcatcctcatatcaaaacctggcagagacacaacagaaaaagaaaatttcaggccaatatccctgatgaacatcgatgcgaaaatcctcaataaaatactggcaaactgaatccagcagcacatcaaaaagcttatccaccacgatcaagtcagcttcatccctgggatgccaggctgattcagcatacacaaatcaataaatttaatccatcacataaacagaaccaaagacaaaaaacacatgattatctcaatagatgcagaaaaggccttcaataaaattcaacagcccttcatgctaaaagcaatcaataaactaggtattggtggaacatatttcaagataataagagctatttatgacaaacccacaacaaatatcatactgaaggggcaaaagctggaagcattccctttgaaaaccggcacaagacaaggatgccctctatcaccactcctattcaacatattattggaagttctggccagaaaaatcaggcaagagaaagaaataaagggtattcaaataggaaataggaagtcaaattggctgtttgcagatgacatgattgtatatttagaaaatcccattgtctcagaccaaaaactccttcaactgatgagcaaattcaacaaaatctcaggatacaaaatcaatgtgcaaaaatcacaagctttcctatataccagtaatagagagccaaatcatgagcaaactcccactcactcacaattgctgcaaagagaataaagtacctatgaatacaacttacaagggatacgaaggacctcttcaaggagaactacaaaccaatgctcaaggaaataagagaggacacaaacaaatggaaaaacattccatgctcatggatagagagaatcaatatcgtgaaaatggccatactgcccaaagtaatttatgcatttaatgtttttcccatcaagctaccattgacttcctttaccaaattagaaaaaagtactttaaatttcatatggaataaaaaagtaccccgtacagccaagacaatcctaagcaaaaagaataaagctagaggcatcacgctacctgacttcaaactatacaaggtcacagtaaccaaaacagcatggtactggtaccaaaacagatatatagaccaatggaatagaatagaggcctcagaaataacaccacacatctacaaccatcttttctttaacaaacctgatgaaaacaagcaatggggaaaggatcccctatttaataaatggtgttgggggaactggctagccatattcagaaaactgaaactggactccttccttatgccttatacaaaaattaacttgatatggattaaagatttaaacgtaagacctaaaaccataaaaaccttagaagaaaacctaggcaataacattcaaaacataggcatggacaaagactgcatgactaaaacaccaaaagcaatggcaacaaaagccaaaattgacaaatgggttctgattaaactaaggagcttctgcacagcaaaagaaactatcatcaaagtgaacagggaacctaaagaatgggaggaaatttttgcaatctatccatctggcaaagggctaatctctagaatccacaaggaacttaaacaaatttacaagaaaaaaacaaacaaccccatcaaaaggcgggcaaaggatatgaacagacacttttcaaaagaagacatttatgcagccaataaacacatgtaaaaaagctcatcatcactggtcattagagaaaggcaattaaaatcacaatgagataccatctcacgccagttagaatggtgatcattaaaaagtcaggaaacaacagatgctggagaggatgtggagaaaaaggaaaacttttacactgttggtgggagtataaattagttcaaccattgtggaagacagtgtggcgattcctcatagatctagaactaggaataccatttgattcagcaatcccattactgggtatatacccaaaggattataaatcattctactataaagacatatgcacatttatgtttattgcaacactattcacaatagcaaagacttgcaaccaacccaaatgcccgtcaatattagactggataaagaaaatgtgcacatatacaccatggaatactatgcagccataaaaaagaatgagttcatgttctttgcagggacagggatgtagctggaaaccatcattcttagcaaactaacacaggaacagaaaactaaacactgcatgttctcactcataagtgggagttgaacaatgagaacacatggacacagggaggggaacatcacccactggggcctgttgggggttggggagcaaggggagggatagcattaggagaaatacctaatgtagatgacaggttgatgggtgcagcaaaccaccatggcacatgtttacccatgtaacaaacctgcatgttctgcacacgtatcccagaacttaaagtataattttaaaaaattagcaaacaccagcttaaattgcagttaaaactacatagtttaatggccaggggaaaatcaactgtaaacaaacaaaatcagtatcttttcataggcagcattttgatttagcatttgttgaaaataaaattcaaagcctctcacagaaaacctgcctccttcagaaaaatcaccagttttggagcatgtgtgatcccattccagctaatatttacagtagcatataaaacagctacaaataagtcacatcttcattgctacattatgccaaatgcttaatttcccattttatgttcccttgtcaattctctcctgcttctctcctgtataatcacagttgtccaattgagacctgatgatcttatcagtcatgcacttttactattattatttaaatttgctcctttcaactattatttattgccaagctttgcagagggaagaaaacagacatggtaaaagaagagtaaaggtgggtcttttctcttttggcagtagcaaccagaaacagtatgaaagcaatggatcatgaagaaaagcaatttcctacttgagggattagatagtaccctcttttgtactgttaaatcaaagttttagttattttttccaagtaatactgattttttcaatttacataaacagtctctagggaaactgcaagagacccccaaacacataccctctcagccaatcaacagaaaagataaggaaaatgaaaaaaagaaaagaaaaaccaaacttcctttatgttgtactgctttgagcaaggctttacacagcatggcaaaaattaaactgctacacaagcaaaagataattagcttaacagggaagaatttgaactgatacatgaagctttttttttctttttttcagtaaaagtataggtgatttttattttgaagcagttcacttttgctagcattagaaaattgaaaactatgtaaatttcagcaaatgtttgctttaatgtttaggttcacattgatattaaccacagctatcagttggtaataaattcagatttgagaaaatttgtagcagaaaactactctgaaatgtcatgtgaaaatcctaatcaattttaaatgcatttacattcatggaggaataaaacctactcttaaataataaaggaaaataatagtacatgtataaaatgtgaggaaggaaaatcatgagtctattttcacagttcatttgtaaaggtttatcacttatatgacgtatgtttaagaaagttacaaattttctatagtgaattacttttatgccatataattaacaacaaaaagtcttcatagctaaataataggtttttgataaaaccttataatttatttcagcttattcctgagttgcccagtttttaatgtcttaaaatccatcacactgttgacagatacttgaggtaacattaggtgattagctgacaaagttctagctactattttaattgcctttttcccgctttgtcaaaattctgatgctattaagtcattgttgaactcatcctatatagacagtaagaacaaacaaataagtaaattaacatagcagacatttcttgctttacatataactggagtaatgttttctaaatctggtggaacaatctattgaatacactacaaattctttgcaaaaatgaaatagaataaggaactatgcagggaagccaaattagacgactgcaggtctgtagccaagtggaatataatttgtccattacaataaaataaccttagaagtaggttgaagtcatttagtatggctgaaatttggagggatgaatgttactttcacccaacataaattccttaatccaatagcagataataagaataggttagttgggtaaataaagtttgaatccactgggttttctcggctggacactttttttttttttttttacatccagagttggatttgctgacaggttagagaatgcaacgtatgttgagatttcccagattaaaaaatatataaaaatgaaataatttgtaataagactcagatccaggactaaataattcaatagtctcctatgaattactaggtagtatctatatagaaacaccaagattcatcttaaaaatcagtgactgttcagtcgtaatatttttggagtagccctgtccttggctcactagatggggctatcaacttagacaggctgttgtgacagagtaattctagtttagtattcaatatccattctgccttcttcctggcaagtagaaccatttgaaaggatgagggggaagtgcacagagtagcaatatgtcccactaaaaatacttgctttccaaaacatccttagagtgagagtgcccttgtgacccagttaatcttgaaaaaatgtaaattgaatttacataattaggacaatattttcttaaaggtaggttttggtagactgtctcccccaccccactattttttgccataaaaccttattcctgttgctctcaatgcagagtgaatgcccacgacaataccaattctgagatcatgaggtcaaaaatcacacactaaggatggagaagaaagaagacagaaggagcttaaatgtttgaggtctccctgcaggagttataccagccctgtgtcacctacctttggacttcttattcaatttgaaaactaaattatcagtttaatcctatataagtcaggtcttcaggttttggaagctaaatacacgcctaatggatataactattttcttgaaaggatgattacttagatgggtgagtacgccagctgaggcctccaggcgtctgggagagacatttatccttaaggaaagtagggaacatattatttgctttgggtttctccagatgcattttaggaaagttaaggtactttctttaatacaggagcccattagaaataataactcaaggagaataaggctatcctcgtctcttgaacagaagaaaatgtcgttgagtaaataatactatggaactaaagaaatgcacctatagtccccttcttaaacatgccataaaaaaggaaaagatatccatttcctgtagaagagaattagagcttaatgaagacacactttcaaccaggaggtatctgatgtgggcttattagtaagaaacacatcttcccaggtaatacaactacatgtgagtaagtgcagcctgccatacattctttcatccacttaattatcaatatatcaaattatttatttatctagcaaatatttattgagcacttactctgcaacaggatctgtaccaagccctggactcattcagaaataaatgattggggggtttggttctaaattgaggaaacaagtctttgggcttactgcctcctcatcctgagctgggcagatccccatcctctcttgaagtccatgaaagcatatctaccttctgacatgcagaaatggccctgcaaatggaatctaactggagctgaatgagtattcttgcctcagttaatgtattttcatacttagccagttccaaagcaacaatgtgcacaacttagacatgcttattggccaggtgcttaccacctatttggcaaatgctgtttatgaagtttttaagaaacaaatattgatccaaaatttcccttgcgtttaatattctgtcattctgcaaggccagtattaagtttgatgtacacatacaattacctgtctatctaaacagtttcaactgccctaattcttgggcaccacaccgtgattaaatgtatacaagcaacaagttcttgatttgggcagctagaaaaccactgtggcataagatcaatagttacaccacttagcaaagactgtctttgtcattgcttcctagagtcctcaaaggtcctgataaatacttaaatctagcttgttctttcttttgtgcacatgttgttcatgcaaatgaaatcaaaatttacctaggaagattccagaggacccatacaggacagaagattgtttaaattatggtagagctcatgaaacacattttcaactggtgggatatcctccttatgagactcccaaattctttagagcaagaaacattaacaagcataaatgaaaaaaaaatcctgtatgaagaattgagaaaatagcataagcacagtatgaggaagacctaattctatagttgttattacaaaaaacctggggatttttactaaacaaaaatgtaacaggcaaatttgatggaccttttagcagaaatgtttgtatgaattgaattctagtatccagatcatgagagtaataatcatttttctgaactttgcataagacacacacatgaggtatgttggacatgccatgtgctcattttaaaagatactttgaaaaacaggtgagtgaccagatggttataagagccatattcagtctaaagtaacagagagtaaaggagatagaatagacatgctcaaatctttaaggattttcatatagaagagaagtaggctaattttttattggccttgaaactataggaaaggccaacaggtagaaataggttaataaggaagcacatattgatgatactcaacatacatgaagtggagtttccagaaagcaaacgagtgggggtttggaactaacctacattcccacagggagtttttggtttttcccctgcctaagatcttgcctctgaacatttctttagataaagaaattatagcatttgtaataaataacaagatggctttaggtttaattgtcagccaagaaaacagagtaaattcacatgtaagagtggaagggaaggagcaaaacatcgacattgtgatacatttgggtgtaccctgactaggcaaataactcatcgccaagtaccttcccagggagtcaggtaaccactaataagaaaatagacttatggctataatcctatatattttcattcatatgtctagctcagagaaagaggtgagtggtgagaaaaatcacagcaactgcagacaagggtctataaaaggacatttaaaataaaccaaaaaacccgaatgaatacatttacttaatgtgtattatatatagcctatatattttttattaaacacttccacacttaacactgtatctaccaaactatcagtttcagattaagcttattaagtgtactctgtttgatcataagtataaagagttttctcagcaataattcttattcttccatgccaaatcacatggattgatcttacaggaagttaacaaatcctatatttccaaataaataggcccaaataatttataatgtgatggtgttacttgtcttctatattctggtagaatcgatggacagctaccttatgtgctttcaatctggaaaagtagccagtttgtgatgttctttttgatttctgactataatttccctccataatattccctgttgtctgaaacacctacatatctgaagctaacgggcatctttatagtaagtgatgctgaaataacttctgacctacagctccaggaagagtggctaatcgaagtaatgatcagtgtctcttctacccatttctgtgaactctgatgctttctgaatgtacggagactggtcaagatgttaatctcccagtgtagggctggaggacagtggtagagaaccactacatcaccattgggaggagactgtagtgtgaactaagcaaattagagaatgtagaagaaaggccaaaaggaaaatataaaatgaataatggccatggctaatcgcaaaggtaaatgtatctcttcataaaagaaatttactctatttattgaaagctgacctcaatttctacctcttttcattgagactccattatctactcctatactctcttcagttgttttctctgcaattttgttggcatgattttagttcccatgtattgttattctatctctgcatgtacattgtccctccaactatattgcaaatacattagggcagggtacatgtttgatgttgttttgagtctccattttgtcagcaggtgtttttcttcttcccaaaatgcagcctgccagccacttacaacattttcccataaagccatggtttaatattgtacatcaccctggacttagtgaatttgtaggatgtgcttaggaatctgcattcttaacaagaaactaagcaacaccgatgctcacaaatgtttgctagcctaaggcctaccacagaacaggtgctcgtaaatgtctggtgctgctgttagaatgatgctttctggcatgtctgtatgtatctataaaaaaaacaaagagatgttgatttgctcaaggtgtcctctctctgccactagctagtaaataccttgagggttcatgtcctttgcagacagttctctgtatctccttctaaatttttttctatagcactaagtacttcctagaatgtaccataaataattgtttatgttaaggagtagaaagggaaaggtggtggaagaggaacagaaaaagaagatgaatttatggttgggaggcatacaagggaggtgttattcagaaaactcctttgctttagcgaacacgaattcaaaagtgctaatgaagtctcttcctaatcctttctacttaattcctttgctctgctcttgctaagactgaaaattaccctcctatgatatttttgagattactaaagacagtcttgtgtgaactgaagacaggtcacaaatgactggcatacaacaaatatgtccttagtatctgagatactaaggaactgccggtacctatttttcctcctcaaattcaatcaaaggaaatcatttccatgtcaacatgcacatgcatgattgtatatatatatgtaagtataattacttcaagtggataaacttagcaatgatctttgtcgattgagggcagtgttaatgagctgtaaaatggactcaccctggtgcccaattgtcttttattacaaagggcattctttaacttccactgaggtctaactcccacacaaaccttctgtgctttcatttgattattaccaatagccaaaagtcaaaggtggaaattgagacttaagaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttggggtgattttcataggcatacatgtttacatagcaactccatgagaatttacaataagtagatgctgatattcattgactattcagatagtcttcaacttaagatggggttatctcctgataaactcatcgtaagttgaaaataagcagaaaatgcattcaatgcacttgatctatggaacacaatagcttagcctagcttcaaatgtgctcagtgatatgagcttacagttgggcaaaatcatctagcagcacagtactctgtagaatttcggttgcttaccctcgtgattaggtggtttactgggagctgtagctaccagctgctgtccagcatcttgagagcctatgaactgctttctacccacagttgcaccaccgtaaagttgaaaaatcctaagttgaactgtattaaattgggggctttttgtaatcatttaggagtattaataatatgtaaacagtaagagggagaaatatacagcaataaatgcagatggctcattcctaatttgagaaacaagataatgcagtttattctgaaaagtgattataaatttgaaatttatggaaggaattcaacatcaaacaggtaactttaagagggaaactcttcctgacccttagctagactaagttatgttcagataaagcaatctgacttcacacacatatgggttgccggacttttctctcacttacataattttgaaataatttgtggaatcatttgtttaatgtaaacattcttagattttccagagagattatggaccttgccttggtcatgggtgtagtcccagcccttagaagagtatctgtcatgcagcaggcattcaaaaaacatttgtttaatgaagaaatgtccatgctacaatatgtttgaacagaggagagggatagaaagaaaaaaaaagactggaaaagaaagagagagaaaggcattattcagaggaagaagataaaagagatgaacagagactggactatccccatgacattcaaaactgaccaactgactctttgtttcacacattgagtgacccaggtcaaagccctatcagtcagtatactcactttgtatccctgacacacatatattttcctaagaatggttgcagagaaaggctggaaaaaaaggggatggaaatgaacattaaagagactgacagggaataataacagtgaaacagacaaactctattgtgtacaactccacagtcgaacattttctacctccctgagaatcagtctcgcttgcaggtagagtattgactgctaggcagagcaccatggctataaaacagaccactgagctaggcaataaaagagagagagggagagagagagaataagaggtctaatgtcttgtttatgtcccctttatagcatctttgagaggctctgcagtcccacagctggctttagttcatatgcttttctgattaaggcaatacgtaccaaagcaatctaatattaacgtgcaatttagaaaaaaatagaagggtgtaaaaaaggaggaaatctccacaaacagtgtaactaaacaataaacagaatacaagacttgcttaattctttattaaatacatgctttattttaagtccctaaaacatttgtatctcattttaaacacccagttctaccatattgtgtttagtgacactaatccttctttatagcctaaccctttgagaaataagattatgttcccagtaaatagtagtaacaagttttattataacaatcctgatcacagatttataaaaaccttaaagaaaaaacatggaaatagaaatggctaggataatatccaatatgagaaagatctttatttaacatgaagtataaagcttggctgatgaaatgtctctaagaatatttccaagaatatatattttttacttttcattaagaacttgactactctttttaatcttagacattggttttatgctttataaccttaccattgtgaaactcagcgagcctagagaagtttgggtactgtgtgcaaatctactcaagtgtttagcttaccacattgctgagaaatgaccacatatgtgtgtgtgtgtgtgtgtgcgtgtgtgtgtgtattttttttcccaagagaatctatcttaactctgctgattatactatataacatatcatgactatcttaactgtcaaaatggtcctaaggttttgacgcaactgtttcaaataaacagttgttttcaattcttttttatatatttgtatctgatcttgagatttagattgataataatagtagagtggttaagtgaagaaatttaagagtcagagaggttataattctggctcagccacttactatctgactgagcctctgttttctcatccataaagtgggaaaaatacctagccactagggattgtgtgaggattgaataatgtgccttgtgcaaagaagacagcacgtgcccaatacataatgtgcactcaataaatgatagcaatttataactacaataagtgattgttagtattaataataaaagccacccgttatagtgcagtactgttaccataacaaagcctgatgtctatctcaattctaagaaaggctattttctacctcctgtcttctctgaatttctacttatgccatattatcatcaccaataaatatttcttgtaagcctaataagcataaggtattacattaggccctctaaagaatacagccagaatcaatcattctctcatgtgggccactaccagatctgtacttcctctatcatagcagcaatattctatatagtgatgatttatttgtctctatttaacccactggatagtgtgctttcatagataagtcttactctatattcccagcacccagcataatatcagggacataataaatgcctatccaatgcagaatgaatgaatggaacatggataagcccaaagagttcaggttgaagagagacattatggacattcaaaagcctagagaacaagacaaagtttcatatacttatgaggaaaaaaaaattgccttctctgtgtcagtgaaatgctattgttaattcataaatgaagtagtagtctcatcacgacagtcttctgggtggtttcatcttatattgtgaacaaaggaatgggtggcagaagagggaggaagaaactcttaaaggatgaattaccaaagagtacctggggaaacaatgtgattttttactgggcttacggcatgccaatcttgttagttttgcgaataaactgacaagtagaaattggaatttagtgagaagtctaaaggggactcaggcttttaaacacacacacacacacacacacacacacacacacacacacacacacacacaatctgcttttggctatgaaaaggagctagagtgatatagaatggcatccaagagagtaatgcacatcagaagaaactagctccagatactattaggttggtggaaaagtaattgtggtttttgccattactttcaatggcaaaaactgcaactgcttttgcaccatcctaatagttttaaatgcaaggtgcttaaactaattgtagaaccagccttcttggccttatcaatcaactagcaaatatgcttcagtgtaagtcaactgatcagagggacttttgccaggagtagtttcagagattctaagatctggggccatagatgcatacagtaggaatgatttaagatgggtctttagtgtagaatcctatgaattccagagaagactgttacaggacagagaagttatttagtctgaccaaccaggactgggcttgaggtagtttctgaagagggattctgcaaggcccagagtagagcagagagagttgctcaatctccgaccagaactaggagaactagtttaaaaggaagttgtaagaaagacctattactctatttatgaatgaagtaaaggaatgaagaccttacaagaaagatcagaaatccttatcactagcatacaatgtctactatacagtaggcaccaaatatcatcttgttaaattaatttgttgttgctctgatacttccccattgtattgatttatctttaaatgcttatcatgattttaatttggaaataagaatagtcttctcataatattggagtgtcaagtgagaaataacaaattgtggttagacattgacaatctctgataatctgtcaagacttttacagactttacttagtttaattatcatgggacgtcagagggaatatttacaccagtggatactagaaaaatgaaaaatactggtttcttcaaaagtatagggaaacaaagaggaaacctttctcctgggcatcatcacttatttttctttgatatttattaagtgcacacagcattccaggtctgaaatagcctatggccaggaagcttctcctcctggactggcattatttctccctagatagagagttatgaaactccaaagcggaaggaaaagttcagctgtatacgtatcatctgaagttccccatgggcagaccagttctgattcaagtcaggacgagaagagattagcgagtgggaagacagacatacggtgaatgtcagttgtctctgaatcttgattctaatgaaaagtcacagcttttactggtaatgccctgaagaccaggctaactcagagataacctttgcttaggaagacttcttgagccgcctcaggttcaccatactttttctcttgctctgaatcctcctggtacttatcctcacagtatctacctcactcatttgcattatcttgcctttttttattttagaattgttcccatcatcatatatgttcttggtcacaagcaacttgatcgtaaataatattaattttccttatgatctgattctttcagggccaatcaggttgtgcagaatgaattaatgtgaattgaaattttcctaaaactttgaatcccaacttaggtcttcctggtatactattgtgaggatttcagcagagtacaactaggacagaatatggtctggtctgatcattcagtattgaattgacctaggaaatactctagaagatacttggaacccaggtatcacgcggcctgttttccattcagattcaccatcatcagttagcgtaggagaaaaagggcagaaggaagaacaagaaagtaaacagctgctaccattaagaggaaatctccatacagtctgagatctcccaggctcaaaacacatgagatttaaaacaaaaaaaaattcttttaaagttttatttttagttaatacacaataattgtacatatttatggggcacaatgtgatgtttcagtacatgtatacattatacagtgatcaaaatatattttaaggattcccttcaattgtgcattggccacaccccctactatggctttattttcttctcagaaagaataaacctgacaaaagaaaactaggttaagagtgggaagaaaaatgggtcctggtactccctgaaaataatatacatttgacaaatcttttacattgcttctctccataactgtaaaattaaaattcttgagcggaatgatcccttacagattttttttcagccctaatagtttatgctgctatgattctagctaatcaaatctactcctgacagtttctcaccactgtggaaagtactacaaaaagaccagttgggaactggcagctaatcttccatccttctgatagctttgctgaaaagccagttcaacttaccccgtttatacatgttgaacttgcctagatgcctgacctttgtcagattttgaagagaagaaagtaaaggaaaggagaaaccttctctccatccaacttttactacacatgaagtggtaggtcagcattaaatgactttttatctgtttctgccttgtgtatcagaatatggattttcctaagtgacatcaagcttaaaaaagaaattagctagtaaatgttttcctatctattgacacaaagtaaaattatgatggctttaaacaatgcattctcagccgggtgcggtggctcatgcctgtaatcccagcactttgggaggctgaggcaggcggatcacgaggtcaggagattgagactatcctggccaacacggtgaaaccccatctctactaaaaatacaaaaagttagccaagtgtggttgtatgcgcctgtagtcccagctacttgggaggctaaggcaggcgaattgcttgaactcaagaggtggaggttgcagtgagccaggatcatgccactgcacttcagcctgaatgacagagcaagactccatctcaaaaaaaaaaaaaaaaaaaaaaaaaaaaaatgcatcctctacataaggtattgtttagggcccagtttcagttgctgattgtccccttctctactaaattcttcaggtctgtaggtagtactctttcccatgcacaaatacccaactaatcttcagacttggaaactccacttaatgggttgtcccaacattttctttaaatccatgaatttcacacttacttccttttttgttcaatacttcaaaaaaattattattacttttagagccacatacaaccctgtcttgcatctcttgtatttttctccacctacacatgggcctgttttctttgattctcccaggtctatcccagctgctccttagaatcattcacccactcaactcttggcaacttctacattgctgtcccttaatcttggaacagccttccaatcaatgtgttttgagccacctcctaacttcagaaagaaaattcctcaaactccatctgtttagagaccatctagtttcaatgatcagtctcctcaccattttgagaactcttctaacatgttgaaatgtaaatactaattgttttcacataaaaattagcaagcactttagcgtttaatccaaacacccccaagctacactttgaatgaaaatcttcaatttcccccaactttcccattttaaaaatgggattgttttatgctgaagttaagaaatgaatctccattgcagtctgtgcatcaatgcatgagtgaaggaatgtttgcattgctttgggcactgtagagcctagacactgttcatgtacacatggttaacaatttacttctctctgcagtattaaatcttctcatgtcagagactaatagatcacagcatagttaacttactcaaatgacttccttaattcagtactgccagaaagcatttgaaagcagcaaatcccagaagtcttagtgacttctacattaagctaatgaaacgcatgtattcatgctacccgggaatgttggtggcatgtggcttacacctcaaaccaacactctcagtgggtaaaccaggagtggcagcgtgccattttcgtatttcttttcctgagctgcacactaccaccactttgatttctatcacagctgattccctttctaggaaactttccaagcttgttctcacacagcctaagagctgccttttttcaaccttcatcacttagaataccaacaatcaacatcctcatgtatttcccatactggtcaacaattttatcaatggctttgataaaagtaacagaaggcatgcctcttatatttatgaatgacctcaaaataaaaaacgtcaaccttaaggtaagtaaagttcagaaatttcctaagaaaaaaataaaattatttattattaaatgtatgtaaataaaactttcttaaaatatgcactacgaaaaggtggaataaaatatatcaaactaaaatagtgatatattttatcactaaaataaataactaaatatacatgcatatatatttatagatgtataaatatctatgatatacaaatgtctacatagatctctacataaagtttttctatactttccaatttctgtttaatcatgctatagtactttgataagaaaaatatattttaacaagtcattcattattgaaatgcattttgttaaatattaaagacatcaatcatacagaactgatggttgtaagcaaaatatcattttgctatatttgacagagataaagttaaaaatttctgcacttaaggtttaaaagataaaatctgtaagtgcaaaatattggagatttgtcttaatagtaatataattgaaaattatcttagatttttttttcaaattaagagtgatctcaacacaagccaatcatgagatttggctgccaaaaaagtaatggttcataggaggtaatttcaactaatgagtcttacagaagtaggaattgagcggttgtctttttttcagcaaacccagaatgaaagagcaaagtcataataagattatagactaataagatgaatataagcaagtatgcccaacaagcaatagaacccccaaattgagaccttcaagcaaattgtgggggcaaattgacagggagctactgatggcatcttatgcccccttgcaacttcaatgattcaggataccaagttgcaatggaaatgggaatgacagttattgcatcctgtggagacaaacatatacttcccaagaatgaagtgtgatctgtgtagtgagaatactgggctacgcaggagaaatactgaattggtggccttgagcaaggcacttagcttgcagttccttaatctgcttgtatttagtgttatgctgcccaggggctggacaaggaactggatggtttataaacacaattatacctatgccttatacaatactccatgagagctaatactattttcaatttatagttgacagaacaagctgagtgatctagtgcatagtatccgaagtttttttctaaagttagcattccttgcttcattgcaaaaagaaaaattagagccacctcaagtttcaaatctgatcatatagggtctgattcacccaatggttcctcacatttttcatgtgttgtaacttttatccatgaatatacaatttgtctggtattgtaataaaacaatagactttcaggaggaatgaaaaggaggtggtgaaggaatggaaaaaagtttcctttaagtaaagctagagtaatctgcttggcattcctcacaaagtttaaaatatatcccatttataacaattataatggacttcagggtgggtggggtaaattgatgagagataagaaaacacctgaaaaggtaaaatccatttctagttaattgttatcaattaagttgtttttctctcactgggacactgttctcagtgccctcaggccccaactacttacagtgaacagaactaatagcagtcagtttcattatgtctccttaacaacacgggaacctgttgtcctttaaaaatatataactgttttaacctttacattttttatttactcatacctaaatagagaacttctgctaaggtaggagaagtgaataccaagttcagctcaattcagttagttgtgctaaaggctaaaattacaggaacagtatgaagaaataattgacagctgaagtgcatggtcctatgaagcttctcttcggggaatctgtgattgctcttaatggcattttcaaaaaaaacaggtcctgttaattttcaagatatttttaaacactcgattacttttaaaataatcagcaccattatgaactcccaggaggctgtgaattaagaaatgaatacctttattttataacattttacaaaacactcactgtggacaataaatatcaaatccactaggggcttgggtaatgaaacacacgtcttgaaaaagtaaaactgaaagatgattagataattaatcacaattaaatttctcaactgattttgaaggagctaaacacaagagagcagtccacagcttcatcttttacttgaaactttttgatgcctcaaccccttacagatttaaggtacatgctgagtaaaccattttggagaagaaccaactataccaggtagaaaaactacattttgggcaatctggggtggggagtacaggcatgattctgaattatgccattcataatacagtgaagtaaaatagactgattatgaatataccatgtacttgaattgtccttgcagtggcacagggctgatatcaaccaacacaaacaataaatataatgtacctacatttctaattgtttataatgaccatcaaatatgattctagttctaatctctttgacgatcttctagaggtcataattctgtggaggacttgccttagctcgggcaacactgagaatccagtacatgtgtactggcactttcatagccacttggaacacatacaaatgctgtatttatctttattgccctgtatacaaaccagggtttggctttcctgtatcctgacagtcaaaacatcttccggaaatgcttctcagcaggaagttggcagtaactctaaaattgggtttctgacagggcattctctaaggagtatcgttgctttggaattataattttatgctccttagattccattcaattatattgaaattcaggatatttgttgaaaccaatcctgatactctgggaatgatagggcattcttttcttatcatatttcagagataactatcaatcattcttttagtcttccatttctttgacacccttttattgaacatctcccactaaataaaggttctctgattgattttatgcaacagcaaagtaaaaaaaaaaatattgttactttgagatgtttatagtctggttaattatgtggtcactacattaaacaaaagaaaacacatcttgtggcgttagcagtatgctgacagcctgggcaacgtggtgaaacctgaagtctacaaaaaatcccaaaaatcagccaggtgtggtggtgtgcacctgtagtcccagcttcttgggaggctgaggtgggaagacagcttgagcctgggaggcagaagctgcagtgagctgagactgtaccactgtacttgctagacacagagcgaggccctgtctcaagacaacaacaacaaaacaccaaaaataaaaagtaaatatgtgtgcaagcacaacatcagaccaaaatggtgataaacagacagattcaggcatatgaataagttgacatgtccaatgtatctagtatcagtcttctttattcctaaaatatggaataaaatatgaacaccatttagtccaatgataattcttacatagagaaagaaagttagacaataagttctgagacaatgtccaccagcatacaagctatttaaccaataaacttagatttattggttaataataataactggtatcaataatatatgaacatgtcattgatacaagtaaatctcttgattagacccaaatgtatgaaattctaatactgattctttgtcttttctctcttctcttatctatgtccaattagtttttcaaggcctctcagaggttatttctttcagttcccaaactacattaggttctcctataatcttttcttggtttgaagcatcttcgataattttaagttaataaattgctattttttatcaatgtccatcttccacttttaaacttaatttcatttagctgacttgtctgcctttgccaatatacctatgaccataggagagtaactggaatgtagtggatatacatatcgttaaaaaagctgttgaaataacccaaaccccagggaaggcctcatattcaaatggaactttaaatacaccattgctggttatacttggtgatgttatggtatctaatttcttttcgtgaaaaggttaaattaacaaattaaaatttcagactggcatgtcaaactcagaattatttataccaagttaggcaatgaaatgcctacatcttatacttgattttatatactttcttcgtcttaaatagtagtattagactgtattgagtatcaaaccataagtatgcattctttctgtaaaaatggtcaaataaagacaggtaaaaagcatggattttcctgtatgtttttatagaaatttcatgtaagctaataagttataggtttgcctatttaaacaggctttcacctggaggacaatggggtgttacaggaaataggagaaattctcataaggatgattaagttttcctaacttctcctcctgccctttttttaattccatgaatcaaaagggaagtcccctttgtacattcttcttttaacttataaaatctatttgaaaacttataatttaagagaagatctttttgtgaatttaggaacttattcctgagagcaactaatttacacaggctagtgtggctcacgcaatgacttaatttttaaaatatcaatgctgtgtaactgtactattgctacaaaagttggtgacaggagaccttggtaagtgttatggtttgactgtgttccccaaagttcatgtgttagaaacttaatctcccatgcagcaatattgagaggtgaaaactctaagaggtgattaggccatatggatctttcctcataaatggattaatgtcattagtataggagtgggtttgttacaaaagaaagtttggccccctcttgctctcttgtgctcccttgacccccacctcccctcaacacacacattttaccatgggatgatgctgcaagaaggccctctccagatgctagccccttgcttttggacttcgcagccaccagaactgtaaggaataaatatctgttctttataaattatacaatctgtggtactctcttatagcaacacaaacagattaagaaaataaatcatattagtatttcacaacctagaagagcaggaattttaagaataaacccctgaagcacagagttgatgtcatttattctaatatgctctggactgattttcccagactttggaaatgttttacctttaacttccagaataactttcaagaattttggcctccctagtagagctcagagagctaaaacagcagaattaaaaggtcttgggagtgaggcagggcagatgaaaatgagaatgttgtctcagatatgttagagagtttcacaagtttgcagaaagaaaaaaaagcaagaaaagacaactgaaagatacaagtaaataagactgagataaaatgctggaataaaagagaagatccctgagttgactgtgcattaatatggaatgggaaggggaattgaaaaaaaaataaagcctatagagcaaaattttattagaatagcaatatcataagttaatgagtttggttataactaaacctaattatagtgctttaaaaataatcttcttgggaagagaatccatgtgtttcaaatttacattacatttgaaatacaataaaagcaaccctcttaaaatatagttattagggattttatcacttattttgaaaatctaatacatgatattgaagcgttgggaacactgggacaatgttggtttttgtcacaatgcagctttatggcaaggattcctattcttgtttatttaagttccaatgtactaataagataggctggcttttagcaaatggatcaatgagtcttaatcccagatctgagactctctgttggttacaaagcttctaatttacacagaagaataagaattaaaatggtcaggctgcaacaaatggcttagggatgaatgagaaacaattgaaagtaatttcctcaattatgtctcttctctttttacatgcagtttctgtacaattcagagaggtacatacagagggaccacttcatttagtaatctatgtttccgacaataaaagaaatcttatgaacaattgacttattttcatttgtaaacatctctgcagattaatttttgctgctacttaatgaggcagattatgaaacttacttattaatttatcaaagttgccatctatgataatcattgaggtgtccctctcttgaactactatctgttcatcaccaatacagccaatcatgcaattctaaaatgatgtgatcacaaggcttacatgataactagcgatgaattcatcaaaccaaacttatttaataataccagaactagcaaaaatacactaaaggagaaattaaactgcaaataccttctcaggtaggctttttatatgattgtcttactgcctttctaattcccatagcgacctcctttgttattatcctgctacataaagagttgactgagttgaaattacttacagattatcactacaggatgcattttactatactagcgttttgatagccctgactgtaaaacattgccagatgataggatcatagaagaggaatagaaatgtcaatgcatttaagtcatgagaaggtgccttagactgcaataggtaaggtgaaaaagagatgtcttttacaaagatatgcaaatattaaatatcataaatcagttctaaattttgagctaaactctcagaccagaataatttcaactttaggggaaaaggtgaattgatatacagtaatagaggacaaagagaaagctcatagtggaagtaatattctttgtaattggtcatagttggtgcttgataaatacatgtttcatacatgaataaacatgcgaaaacaaagacgtagtagagaaaagttttcaaatgggtatcctgaaagctatatcaggactgctaactagatggtttggccaaggtagtgtattaaaagcaaaatgagcttggtacagtggtgtgcacctgcagttctagctaccagggagggtaaggcaggaagattgcctgagcccaggagtccaagaccagcaaaatgtacagtgtttaaaaatcaacagattttactttaaatcttcatttctttaaaatttggatgacatggaaacattcccgggaaagaagaaaaaggggagaactataatggataaattgcaggcaacaaacccaagacattttcaaatcaacaggtgccatctcaagagagaagccattctattgtccagatgttatcaatttctaggtattgtaatttaagggccctctccataccaaaaaaaaaaataataataaaacatatgtatactggatgttttccttctttgaaacaatttatttctttaacatccaaagcgctaaacattacgtctgtttttcttatcatactgccatttattctcagaactcaatcgcctctttagacaaagtgcatttctcacggtacctggtttctttggtcatttaatttatctgcttgctgaaatttgagtcttgtgaccctccaagtagaagttcaatgaaatatttcagggagaaggattacaggatagtgtgctgttttcaaaatacacaaaacaggaaactgttaatttaagaagtaaagatattttggctgtggaaaacagaaagaacttaagaaaaatgagaaagataggtaaaattaggctgttccaaagtctggattttttgaaaacttgagatagaatgtatattgttcctcacttttatcataacaacttcatttttactagtatttttattctctgaagtttgttacatcgaagtgttcctttagcaggaatagatagatttgaaaaataggcttaatctactatttcttcaggactttctccctacatgagaatctggcaaaattactgctcacttgctgctgacacatacaattcccaggaaaaaagaaaataagaggaagaattatgcgagaaaaatcacaggcagcaaataaacccaagacattttcaaatcaacaggtgtcatctccagagagaagccactttgttgtctccatgttgccattttctaggttttgtaattgaagaatgtttctctacactataaataaaacatctgacacggtagattattctcttttttgaaacactttattttttcagctttcaggatgtcacacgctagttctatttttcttagcttgctgaccatttattctcagtattctctgctagattctgttattttgtgacctccaaatatgagaaggctcagttttcatatctcttccccatctaaactccctttctgggtaatttcatcttgtcctgcgactacaatctatctatatgtgatgatgcttatgcttgcatctccagccacaactctccctgaaaattctgactcatgtatccatctacctacttggatgtccactaggtatatcaaaaccaaagtctaaaaacaacaacaaaacatccacttttccactccaacctcccccaaaggataaaagtcttgattttccattcgcaacaagtcttccgctaataacaccactattctcacaattaagtgggtcagaattaaagaatatatttaaattccgctttcttccactccacacctctaatctgtcggcaagtgcagtctgctctgtctctaaaatgcatgtgggattttaccacttattggcttgaacctcacaaccacctaaatctaagccaccactgtctcttttgtggacgcctgctacagcatcctaatacggttttttttcctccctcttctctgcaatctattgtccacactgcagccagagttatctttttttaaaaaataaaagtcatcctcatgatcaaatgttcccagtggctttctaacacacttagggtaaaattcagatccttttcaataacctgaatgatatgagaaggcatctggcctccttcctgctcttcctggcctcctactctttttccttcctgctcatgctcctccagttacccaggtcttcttattcttcaaacatctgcatttgctatttccatgccttgtgatcctcttcaccaagacagtcacatgactacttttcttatttcattctagggtataataaaaggtcccctttcaaagaagcctctcataatttttcctaatataatctcctattactttctagctcactttttcccatttccctgctatgcttttcttcataggtattatattatactcacatcatattatttcttttttctttgttattgatattctccaatagaaattatgttctaggaggataagaattctattttgtttacacttgcccataaagcctgacatatagttgacactcaacaaatggttgccaaataaatgaataaattaaagactacgagattgaaataccagaaaatgatcataacacttgtcctaattctttacctcacatcaaaaagtgctaaaatgtgctgtttaggaacccaacaaagatcacttaaaatattttattaaacatactcttctacaagcagaagacattataaaaaagaatttttttctacacattatttatcttgctcacatttactctgatataaaaatggattctaacgtatatatcagctctaggaaaaatcaaagcaggtcctttatatgcttgctagttttaaaatacagtctgatttcatccacttcaattgaatacgcaactaccatttccttgtactctgctgaaacttgtgaaagataacaaaatgaatcacaataactattgtttatagaacaacttaacttatgccagggaatgtgctaaaagctttacaagcactatatcatataagttcctgtgacaactccatgaggtataaggttccctatttcagagaagacaaaactaagtgagtcagacaacttgtcctacaccagacagctgttaagtggaggtgaaatttgcatccttgcctttctgatggctacattggtcatttttagtgtagaactcactgccactagcaggactcaagaacactcctggtgaccctgatgactcagttcatccaaatatgtaaatcctctgctctgtcgttagggactaaggttgttgaaggccatttacctatgtctagagtatccttaccagtagattattgaaaagttattgaattactaaaatttagttttcataaactaaaattagtacttaatagagtttactgagaattctaattcaatatcctaatgagaaagctggctgctacccaacacctgagagcaatgcaaatcgcaccctctgcaagagcacatgcaaacaggcagaactgccaaaatcttcagcacagataaaagtgtaagtggttttcaagtgccatttaaagtaacattattcctactctaaataacaaattcctgtttatttagacttcattattgtcaatttaacatgtgaaagtttctttgcttaacagtatcacatgtaatggtacttatttgaatcagaactatttgtgatctaaaattgtattatggatatatttttagatagctacacatagcaaacaatatgaatcatccacattcctgctacaaagcaaatatatacatatatcacaccctgcttgaattttactaggtagtgaattttttgttatcaagagtttgagagttttttgttttgtttttggaatgggttatgaggaattgtggtcaaaaaacgagaacttctttttggtgttaacagggctatgtctgctttgctctagtgattcctaacctactgtgcgaaggaggcatagcaaggcaagactgtttaagtataaccataaagggactcacgcactctcaggtgaagtgcaaaaatactgatcacggtgctcaaacattctggaggagtaagcattcaaattcagaaatgtaagatgatttctcaaagaaaagaggaaaaacctatcattaattttttaaaatatatcttccagagcaggtttctcaacaattttacatagaagacgagtatttttgtctccttaagatttggacttaaggtcaaagttgttgaaggttgatcggctattgtaagcttcaggtgaaacctagagaggagaagggaagaagataaatctactatcctagattctttttaagaagcagcacgttccactcctgactctcccgaagatggtctcaggtcttcaggtgaccctatgcaaggaccctactgtgcactctgctgagtgttctggctctctggtatcaggtcactgggcctactctacttttggtgtcattctggccctgtgaagaaactatgaggagaatctggtcgatgcattttgtagttaacaccgcaaaggacatgagaaacttagccagagagctattagagtggcgatcagtgacgctgctgctctacccagtctgtcttgtgtgctttaagatggaagacacctaatgctgacttagccttccctaaagtgaacagaccactcttctaaggtttctgcttgttgtcaggaagtataagcaaagaatgacaagcagaacaatggacatttgttaagtgattggcttgcatacgttggctccttcaatgctaacagcaacgagtaggtgccattattacagccatgttacagatgaacggtgggtactattattaagtccatgttacaggtgagggcgtgaagcttatcaaggagttcattggtcatttcttgaccaggacacaagctcctaatgtttctctcttttttaaatctgagttttccaacactttttgatttaagaattgatctggaaagcccttcattcacagttgttttctggctactgtcagtaaaaaggataggctcaaaggaaatctgttgtgtttagaatggtggaggtatgagagatttcttttttatctttaaaagcttcattacttgttttactggtgttagttattgactctttttcctttatagtaacagaattatttctgtatgaaaggttatttaaaaagtcacattctaatggcaatcaattaattgaccaacaaatacagtaaaattgcaaaacaaaaccttgcaatgttcttaaatacatttggacactcaaaacaagataaaatcttacagataatgtgaatacattattagttatttcacattagaaaggaagaatgttggaaaaaaacatcatatttggtttaaacattgctttccacacacacgtttcagaggctgtgacattttcaggatcatagattctttggctgtttttccccttttaagtggggatgatttattggctaagtttccacagtaactcccagcacttgtagaactgtttagcaaatctgcattattttgcatttccactaaggtcacggttttcatagattcaaacagcaaggaattttaaaatttctccctctactaaagtttactggctattgtactcattatcttagcattcttattagtttcttttgagaaagtacacctggtaaagtcgagtaactaaaaagggtatactattcaaacgcaatgttattcaagcattggaatcctactcaaataataaaagaaaagaaaactgaaaatagagtgaacaaggttattatgttaggcagagaaaaaaaacagtattgtggaaaacataagtatgtgtaggatacacatgagacctcaaacagatgcatctttgtggaaatgtaaataatttattatagcagataaaactgggaaggagcttctgctaattaacatacacagtcattttccctgtgtagagaagtccaaaaactgtttccatttgcaggcatgtggtcattagactaatgggcactgcctttggacaggatttacttataccccagctggctcaaaaaagtaatcattctctaattaagaggcttcctcatgtgttttctattgtcatttctagagttccactatatctagcttggtagtacaaaagtggtatgctatttaattatcagccagtagtggggctgagagataccctgagtttcatcatgcagtcatttgtttctattgatggtagaggataggagggtaggtatacaagcatatacatgaaagaaactttcttttcccactcagttggaataaattataacatgtctggacaaatatgtgcgtgactattttcaggactgattggaggtcataatggattttcgaaagtaaaactcaaatagagaataagcttgattattctactaaccctctgtttttatgtttttcacttagattttaaagggttgagtttttaaagggctttagtaattttttaagagacgaattcaagaacaggggaaatggccactcctaaatattgcataaaacctggttgacaccacatgaggtctggaaggatatatttcccattattaaacctagctgtccctcatataagaatgggttacttgcattattttttacttttccattcttgatcaatattttcaaatgtttctggaaatgttttccagcactgttagagggtaacacattttctctactcctgagttcatgaggaaggattttatttttcttctcggtttttccctatgcctttgattaccacagttgggaaaaataattttaggcatgttctgttcagttccatgcttcttcctattgggagagcttttataaggaagcacagggccctttgctctttcaagggctctaattcatgggtgccccttgcccagggcccatcacttgtgtgcatggagttaggcttgcctaacccaggggtccagtaagcaggttcgtgtggctctcaccactaagtcatgttgtccaaattggtctttgtgcattcaggtgtttttgaaaaaccttgttcagtattctgcaaaaacttacactattccaaatctacccagctctgtaacgagagaactggtaaaaaaaaaaaaaaaaaaaaaaaaaaaaaaaaaaaaaaaaaaaaaaaaaaaaaaaaaaaaaaattctcagaaaaatattatcattgaaaggcatttaatttttaataaataaatataataagaacaggtctttagttaaaaattaaaaggataatgttgcttgatagatgggagtccaggaaagaattgtggttaggagacatgagtaaaatgcacaaatgtcaggtagacgagtacaattaacacttgccaaacagagcttgtggcataatgcaccccaagaaagaatagtctgaacaaactgtacttggttcctctacagattgttcccttcacctatttgtatactttgcatgaaactactgttacttgctgatataaaacattaatatgctaggaaaaaaaatcacaaatgaaggaagcgatgtcgagtttcctttatactgacatatttcccatattccaatatgtgtaagattttccacattactgaaatggaaaacatagcagaacagacaaaatcaaggatgataattgtttattcatctacactttccatcttttttaaatattcaaattgtttagaactccataaggagtgctattggggggtaggggtcttcagaaacgccgttgctcatataaacataataaagtgggaacatgattaaaatacttagatttctgattgtaatgaatataataaagaaaaactagcttaaataaataatgccagagggtatcaatggctggacaagataagagtttcattagcaaaaccacaaggcactagaccagaaagtttccaggtgaaaggacattaaaaaggttccattggactaatgaaattggaatacactaacaaacatgtcagtgtggacaagtaaggttctgctcaaaatctgtaaacttatcaagaaagtatctgctagaattctgaatgctgaaactgaaaaaaagtgtgctttgggcaaacaaagaggaatgttttgcattcaagaagtgtatgttttatttttataagatttggtagaaactgaagatatgaatatgtttaagaaatatacagttgattatcaaagggcatgttgtgatgatatttcacacacctgggttgatgctccgcaagatatatctattcatgtcatagtgctgtgtgatcaccttaatgcaaaatcccagagcagaggctcttgtgaactgcactgagaagtgcccactctaataatgaaatattgtggaccttttctgatactcagaaaagtgggttaaccaatgtaacatttcaaatttaaattttcttccatgattttctcggatatttttggccctgttatcaaaatatgttcatattagataccaagcgctttgtttaggccttcaggttcctcattcacactcaatgtgggaagatgcttacattaatttttgtttctaaaatggaaatattttaaaatctataccttaagatgggaaggcctgctagtaaaattactcttaatgtatatgtgtgaatcaaataccaatatcactaatggtttgaaaaatcactgcccaggagtagcagtaactgcaggacagtcaggagatgttccagtctctccctgaaagcagacatgtgtcctttggcaaatggtttgataactggggacttggcttcttcactggtgagagcggggagggagagggcttaagtggcccataaaactaaaatttctaagattccttctagatttgattcccttccaaagtatgactaggggtaccctaagggaagacaggacactttactagatgaattcagctgggatcctacgtgagacgtctttaattggttatattaatagctaatggcaaacaaaaggcaaggcagagaaaaggatggagcaattattgcatgctgagaccattttggggtaggcaagttgccacaagagcctatggttggaattttattttattttattttttacaaacaaaacaattcatttaaaagcaacttaaaacacaaccagggtgattttcctaacagctctttctggtatttcaatatcttgctatattcaaagctggagataatcatgcaaaccagccagccttttcacttcctggaagccctagttcagattattttactcttagggaagtgacctctcttcccctattgacctgggaaggggcagaaaaatcccagtagagtgaactgaaggtttgatacaagaagttgctcaacctggacttgcctagaacagcagccttttattctgattgaatctgtggaaaataagacccagaggaactcagactagtatagcttgtcttcttttatctattactgtttggaaaataaaattaatctgtagcagaagaaaaataaaggtgacaaacatttgctctaggtacctagggatcaaagtaactgagccttcatgtctttttttccactaatttaatacatccattaattttataagtatggatacaagagaaatcatttttttgttggtttttttaaatggtagacttatttgctacatcagctataattttttccacaccccttttttaacatcaaaaaaatgtaaaaacctttgcttcaatgtaaagtatgttgaactgtttccaatgatgaatatcatctgccaatctaataaatgtgagtaaggtgaaaacggaataaatagaatgtgggggcgggaaacaacccttgaaacggtaatcagcaagtaaagctgaattcctatgccatagtgtcccctgctggtcgattacggaagtagtagctttcggagagcaagtcaaacctcttggttaggccatatcatgttttgaacaaaaaaggcacaaaaacgaaaggaatgtgtgcatattgttttttgtctatttctttttacatagtcatcattggcagtgggacgaatgggggaaggattgttttatgcgtgaagaatcccagagcccattagaactaggcttagctcagccacttctccagtgatacgtgatctggcactcacagatctttctttaagcctcaactcctccctgtaaattgcaattagtaataataataaatgatagatttactgcagagagctgttacaaaaacataagaagagaaggaggaggaggcggaaattacacacagtaaagtgtacttaaaatgatatagcgctttccaaaacaaatattaatgtaagggtgcggattgggggagacacttccattaacaattaaactaacttcccttataatcatcaaaaggtaatccaggctgggcaccccaggcatggttgctgagctatcagactttcaaattcctacaacatcacctggtttccaaggacttacttgggtacctttgaacaatgtatgttgctcagataatttatattacacagaatttactatatacttagagaggtctctactggttggtaaacagaggtgatggggtaaaggagattaaggtgctccttgtttgcttgataatcattaatgattgagtctccatcctgttgctagttgtctgaccagcagcatctgcatcacctgggagcttattagaaataaggaatcttagatttcatcccaaacctactaaatcagaatctgcatttaaaaattatcccaggtaattcttacatatgttcaggtttaagaaactccactctttcacatttgggctataagctttctctggcaatacatcagttgttatctagtacatatgtacagaatagtatttttgacttgaccttattttaaaactacttggagaaattaaattagaaggaaaaactatggctaaggataattaatttttatgagcctcaaaagagacgataataagatgactttcctaaatgtaacttagtattatgctactttaaaatttttacagctttgtaatactaattttaaggtaatctcatgtatttgtattaatatacacattttatatttgcccttagtatctgtgttgataagaattttaaaatgcagattatttcattagaagagattttagaaaatagactcaagtctaagcagacgtttgaaaaatctaagagggccgtagcttccattaaaaataccatttacccaatcttttgtcagttaatgccctctgaacataagacaatgttctgagttgttggaagtggactgctatactagcaacacctatgatcacagtttctctatagatacaattttaaaataaaccaaacttggaaaatgagtggatgggtattagaaagaaaattcattctttttcacttactccctaccccctaccacttaccctaagctccacctcacaccctctgttgtgtcttcttcctttaggaatattttgtttagtttttttttgtttgttttgttttgttgttgttgttgttgttgttgtttttggtcatagctatgctctatttaataggtgaaaagactttaatgccagtgcttcacccaggatagtttctttctaactggtccttgctataaaagtatccattctcctcctattatttagtgtcctggctataggtgaaggaagtcatctgattcaaccagtgcacactgaggtgtgtgaactctgaacattcttctttaacctccctagtggaaacccactgagtttttaggaaagacactcacacaactcagtgaaaagcttcttagcagaacttcatacaatttaagacacaaagagttttagggttgaagtgggagatatttcaggacccaggtacctttctgggtccattaagcccctccaatcttctttagcctattttctacctaaactataggctctagctagctacacaggtaatatccttgtagaagggtaacaattgtgagaaaatatggatttcagagtttgtctgatttcctttactgaacactcctttgaaagtattgaaaagtcatatgtttccaatcactaaagttggacattaaggatcaggaaaaaggcctggagggggatctttgcagtataagagttttgactccctgctctagtggtgagagacctttcagtcagagagaaaggatcttgacttgagagagtaacagggtttccaatctgttcctttcattgaacagagttcaaaagaggctcaagggtgcacctctcttaggctctttatattgacacactcttctcttgccaaaagcttggtttgcagaacaaatcaaaaacacacccttgacaaacgttctggtctagaataatcacctcttccccaacttactatgccaaagaggggagcttaaaaatgacaaggtgtgtgtgatattgtctatctctgcattcttcataaatcttcaaagtcaatatatctggactgaactaaggatatatgatgtttctcatgctttcatttaaagtaagatcttgaggatctttccacttgcagattgatatgcatcacagaaaagtttccttgttgatgttcaatgaagtcgcaggctcaacacatgagcctaccaaacacggcaaataaaaatttgttcaagattggaattaagggcaaaatatcaaataaaatgctattgcaaacaatggtgtctcttcaaatgctaggtttggcatagaaaccaacaatctccaagaggtggaaagaaaatgaagatctcttaagggcaatgcaaacttccagagacattaggatttgcttagcatatagaaaacaatgaaaataaagaaaataaaacaaaacttctttctattgtgtcacagtaatccacctgttggtagcacccaatttggggactgaaataatggtgattttcaacagagaaaattgtacatttcctttatgcatcctttcttcactatgtttctgactttttcttctacctcaacatggtacagtgggaagcaaacaaaattgggaatcagaagacttattttgctcccaggtttattactcactcacgtgactcaaacacagtgctttaatttcctgaggaattaattatatttgtatgaaagaagtattgcactctatataaataataattacaggaaaaataataatagctaattcttaatgagtatttcttattctccagtcatttttgaaggtgatttacaattgttaattcattgaaattctcacaaaactctgcaacgctagataatattattatcattgttttatagatgaggaaattcagccacagattggtaaatcatttgtccaagatcatgcagctgataaatagtgaaatcaagattaagtttaggtagttgagctccagagcttacagtttttcatgttaattctcctcctctgatacattttcaatcccctattttgatgccatatcatgcttttccaatgttttctgctttctataaaatgttgatacctctaggaataagtctttaaataatggtttcacacctattgggagaagacatgatgggaaaaccaccataaaacaagatggaacttttaagaggagacacagtcataaatctgttctaataaataaaggggaaaaaaaagaataaaaagttaaccccttaaagaaaaacatacttttaaagtctgtctggatcttttgtgaagagcaaaggaaatgctgaataaaaaaggattttgattgtcctttccaaaatattgtcccttacctcttggacattggtgacaccacccacactccacccacctttaatgacctctactttctagtaaaaaactttatctttgcataaactttgttgttttgactctgcaatcaggaagatacttcatagctatatctagccaggtgtaggtaggatctgagtggaaagacagaaaaggaagttatattcattataaattaatgacatgccaggtattaggcatgtccacatccataattaataacattgggttaagcatttccatttaatacagagagagacagacagagtttgcacagtatctttcctttggttcttatctaatgactgactctcttccatgtacctttaaaaccactaaaataaatggtctacttgggaggttgatatactagccaagctataggtctaaacttcaaatgcaatttaatctatgcagcattcctttttcatagtgaatctttaaagctcaattttttgcattgattgatcatcctgggaaacagaaaaacctcaactcacagcttcaagaacttgaaaagccctaatccagtgcctatatccatcacctctgaggacaacaggaaaattgaaaaggaagaaatttcctacagactcatgataaacttattgatagtagtaatgatatacattttttaaaaaattatcaaattgtgtattttttaaattattaaactcccatggcctcaatattctactctgccaaatgatgggaaaatttaaattgtttctacaatttcccacatctctataacattaaaagatcaacttcttaaaacatatgtaacattttctttccttgccccaagatgcttttaaaggttttataaactacccttctttggacatttttgtcatcaatttgctacttttctgttcaaaatgaataacagcttcccataggcaatgatactattatcctctctgcatatgtaaactacctcgccttcaggacacaaaattcagtcccaaatcactgtcttcagcctcattgatattgtccctctcctaaagactcctatggcttgaatatgtgtcccctccaaaactcacgttgaaattttatccccaatatggcaatattgagtagtggggcttttaagaggtgattgggtcatgagggctgtcccctcatggatgtgttaatccatctgtggattaatgggtcatcatgggagtgggggtggtagctgtataaaaagaggaagagagacctgagctagcacacccagccctctcatcatgtgatgccctgcaccacctcacctcaggactctgtagagagacctccgcagcaaaaaggccctcaccagatatggttccttgaccttggaattctcagcctccacaacggtaagaaatatattccatttctttataaattacccagtttcaagtattctgttataagtaacagaaaaaggaatatgggaaagaccacagcctttattctctgtacatggcttgggcttcatcgtcttctcactcatactattttaacatctgttgtatgtttgtttttcctatccaattaaactaaatgttaaataatgacaatgcactcaataaatacttgttgtccttccaatatttattcagtaaatgttttcagtgtatagtatctatatgcccatcttggaaatctaagaataaataagatataagcccagccctccaagatcttaccatctggaatggtaaggtctcacaagaatggcaatgtaaattcagtgaaatatttccaagggctactgtgaagaatgcaaatctgagtctacaatagattaacatgagaatttccaagtagtaatgagagtctggttaagtttattgcctggcacaagatcacactaataaagaatatttattgagcacttaccatgtccacatttagttctcactacaactctaggcagtgtttctatcttcattttgccagtgagggaattttggctttggagaccagtgttttcccaaggctgcatgatgtagctgagatagccagggcttggtggaacagtctggctttcagtcagctgtaaccactctgcactacttcctcttgcttacttggtgcttttaaaatatttgttgaaagaatgacatgatgtagcatgcatcaacagtgaaaaatatgctctgcaatagactccaaatttcgaggtccccctaatttggctgtaacattgattgtgtgtatgtgtgtgtgtatgtctgtgtgtgcgtctgtgtctgttttagaaatgaatttacattctacacctgacttccatttgcccctctgcattccctattgccacagctgaagagtagaaatgctttatggctctaactgggagcagaaatcactgcaagtcaagagttgggtgaatcaatctcaatctctctctctctctctctctctctctctctctctctcatatttatatgctctaaatctgactgcaccttttcagaacatcatgcatagtatgaggggactaaattaaaacatctgacacaaacattgagagcaggaaaaaaaattgacatgtggtaactttttggagtggcattctggttgatcctttttcaaggggaggggagggttgtttacagatgagcccaagcttgatgcatgctgcagccaagaggcagctctcccctttgatttttcctctatataatctccatgtggtccccaaatgcttaaccctctctgccaaatgctgtaaaatctgtcttttgatttcacagatggaaaagacttattagctcatgaagctcacctccttaggagacaaggaactcatcaaataccatttaccccacccttcgagtttgaagtctttatcagtttcctggccaaaactgttcaacctcctttactcatatgacatcctaagtataaagaaaacaaaacaaaacaaaaatccatctttttgtttggcttctagtggtcttgggactttcttccaaagtgtttctcttgctgtgtttttaggcagtgccctaggcaaagagaaaatgaccatttgcatctcttggttataagtaggcttgtcattctcaaaacaacaacaataaagagacatacttaagcaccctcttttgcattgggacagcatcacctggaccagtttaaacctttcaaacagtacataattatactcaagatgaggattttaaagaacactcgacttggaaaacctactttttgagttaagccctgttaccaccaaatcatttggttttccaaagtttagtttcccagatgatgaaatttcaagttcactacaatagttacatgtataagaatgtaaggtgctgtgtcaacataaacacatgatttgattatctattagaatttagtgcaacctgatagatatgattaggcaattctttataagtggacacatcttttgtaactgattttattatactcttcagttaaaaaataatcatcgttccttcattagttacaggacagagttcaaagctctcggtattattttcaagccttccctaaatctggctttaaatgtctctctgatctcatgttgacattccctacgtgaaccctttactcctgccacattgacctttttgtcctgtgtccttcccatcagtgcctgatctgacatgccccttctttctatccctcctgctcccctacatacaagcaaggatgtagaaactcgacaatcctattctccaatataaccagcaatttttaagcccttcaccaggatagagtgaagaaaaaaaaagagtacctctaaatttgtctcttttttgccaacacttaatacaatttcaaggtctggctggaatttacttcttctctaaagcttgcactgctatcagacctgtgatgctctcctctcctgaattcctattgtttttgttttctaaaacacacatgtgatacttaacatatcctaccacctatgatgagctacttttgtacctatctgcctctcagaagtatgcaggatgtcaactgcacatgtgcaatgcatgttctcatatgtgtacactcttgttgtatgttgtatattcttaactaagctcctggagcaaagaactattcacacactcattctcccaaagaccagccccatggatagtgtgtaatcagtaaaatgaatgaatgaatgaatgaacgaaagtaaactaagatgaaattttaactgctgacctttgctaacactcccatgctaactcacaaatatttcagaaaaaaaaagtataaaaaagacataatgatgagaaaagcattctaggcaggcctattgatcttgccaaaaggagatgcagagtatagatggcacagactatgaagctgctgagatgtgcctcacccactttgaagagagaccagggagcacagtacttgcattatcattccactgttggtctctgaatcaaaagagaaggaggcaagttcctagcttaaataaattatttagaatattgatttaactgcctgaactgtgttaagttatatctgaactaaaagacaaacatttgcgtgtttcctttaatggaatctgtgaattcaaacatatatttgggtttttaaaaataatctccctctccctctccccctccccgtccctctccctctcctctttgcatggtctccctctgatgccgagcggaggctggactgtactgcaacctccctgcctgattctcctgcctcagcctgcccagtgcctgggattgcaggcgcgcgcctccacgcctgactggttttcatattttttggtggagacggggtttcgccgtgttggccgggctggtctccagctcctgatggcgagtgatctgccagccttggcctcccgaggtgccgggattgcagacagagtctcgctcactcagtgctcaatgttgcccaggctggagtgcagtggcgtgatctcggctcgctacaacctccacctcccagccgcctgccttggcctcccaaagtgccgagattgcagcctctgcccggccaccaccccgtctaggaagtgaggagcgtctctgcccggccgcccatcgtctgggatgtggggagtgcctctgccccaccgccctgtctgagatgtgaagagcgcctctgcccggctgcgaccccgtctgggaactgaggagtgtctctgccccaccgccaccccttctgggaggtgaggagcgtctctgaccggccgccccgtctgagaagtgaggagcccctccgcccggcagccgccctgtctgggaggtgggggggcagcccccgcccagccgccaccctgtctgggaggtggggggcgcctctgcccggccgccccatctgggaagtgaggagcccctctgcccggctgccaccccgtcccggaggtgtacccaacagctcattgagaacgggccatgatgacgatggtggttttgtcagatagaaaagggggaaatgtggggaaaagaaagagagatcagattgttactgtgtctgtgtagaaagaagtagacataggagactccattttgttctgtactaagaaaaattcttctgccttgggatgctgttgatctataaccttacccccaaccccctgctctctgaaacatgtgctgtgtccactcagggttaaatggatgaagggcggtgcaagatgtgctttgttaaacagatgcttgaaggcagcatactcattaagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaataaataaaaaataaaaaaaataataaataataaaaataatcttaaagagacataattctctcccttttaaaatacatattcataagtatgtatatttataaagggttatataccagggcaaaagttactgataatgattctgcaagaactcttagtttattgccttcatttttaatttataaatgaaataatctagttcttaggttggctaatacaataatgttttgcttttttttcactctttataaaattcattttacttattttagatacatgtcataaaatcctcacttgcatttgcttatttttgtggtaagctaagaatttaatcttactgaaataattataaaaaattaaagcaatcatacaatataataaaagaacatagtctgatttttgtaaaataacactcagggtatgcagatatatgacagacataccttttttccacacatctacaatgatacaatgatcttattttcaacaaaggcaccaaaaacatatcctggggaaaagacaatctcttcaagaaatggtgctgggaatacaggatccatatgcagaagaacgaagctagaccccaatctttctccatatgtgaaaatcaaaccaaaatggattaaagtcttaaatctaagacctcaaactatgaaattactacaagaaaacactggggaaaatctccaggacatttttttgggcaaaactttcatgaggaatacactacaagcacagacaaccaaagcaaaaatgggcaaatggaatcacatcacgttaaaaagcttctgcacagaaaaggaaacaatcaacaaagtgaagagaccacccacagaatgggagaaactatttgcaaaccctctatctaacaaggaattcataacaagaatacataaggagatataacaactttacagaaaataatctaatgatccaatcaaaaaatgggcaaaagacttgaatagacatttctcaaaagaagacatacaaatggcaaacaggcatatgaaaaagtgttcaatatcacagatcatcggagaaatgcctgaatagacatttctcaaaagaagacatacaaatggcaaacaggtatatgaaaaagtgctcaatatcacagatcatcggagaaatgggagaaatgccaatcaaaactacaatgagatatcatctcactccatttaaaatggcttataaccaaaagacaggcaataacaaatgcctgtgaggatgtggagaaaagggaacccttgtacacagttggtgggaatgtaaattagtacaaccactatagagaacagtttggaggttcctcaaaaactaaagattgagctaccataagatctagcaatcccaatactgagtatataccccaaagaaaggaaatcagtatatcaaagagacatctgcactcctatgtttgttgcagcactctttacaataactaagatttgggagccacctaagttttcattaacagattaatgcataaaggaaatgtgttacatatacataatggactactgttcagacataaaaaaatgagattcagtcatttgcaacaacacagatggaactgggcattattatgttaagtgaaatagccatgcacagaaagacaaatatcacatgttctcacttatttgtgggatctgaaaatcaaaacaattgaactcatggacatagagagtagaagaatggttaccagaggctgggaagggtagtggggtggggggtgggaagaccgtgtgcaggggaggtaaggatgattaatgggtactaaaaatagaaagaatgaataagaactactgtttgatatcacaacagggttactatattcaataatagctgcattgtacattttaaaataacttaaaagagtgtaactggattgtttgtagctcaaaggataaatgctaggggggatggataccccattctttgtgatgtgtgtatttcacattgcatatctttacgccataaatatatacacctgctatgtagtccataaataccccataaatatatacctactatatactgacaaaaaaattataaaaacataccttttttgggggaatatttttcgaaatataccccataaatatactccataaatatatatacctactatatacacacaaaaatttgtataaacatacctttttttcttttgggaatattttttgaaagatgtttttttaataaaaaacaaacaagatataaaatacatgaaaatctttgagtattgtctatctttctttgggtaaaagtcttaaggttttggacactactatccttcttaattcatactaaaaatcataatcactcctaaagtgtagtaagtccctcggaaaattattaaatgataagcttaaaagaaaaatttaatgtatatactataaccatttaaaaaggagagtgttttgaggttgtataacctttaaaagtacattttgaatttctatattaattttaaagtgcatcaattttgtcatatgaacgttcgtaataccaaatatatcaataaactgtaaaaattgagaagggagactatgttgaacttaagaaaatttcatttgaaacctattaatttcagaaacaaaccatacatatataacagaaataatttacaattaaaatttttactgaagctctttcaatggacacccttcatctttcccattactctcttgtcacttcataactatgacatggatcaggcacattaaacatagttctacatgaaggagtaaagacaatgacaaaaactgtggaatggtacataggaaggacttcatagaagcagggagtaggcaatgagttttagtgcttttaaaattgaaaaaagaagataatcattactaactgaaggtctttctataaaataaaaataacaaggtagttcacattaaatacattaaattacagttaaagttatttttaactccacagattaatgcactttccctttcacagaactcattttctattaactttagcaaccagacaccagaggttgcagtgtaaggtgtatttttttatggctcaaatataatttaatcattgtattttctcttcactagattgacaaagtgcactatgaattggtggaaatgcgctgtctcatcatgtgatgatcagaagctgtgataaagatatcatttgctccaacatttctagcacacgctgcatagagtctgcaaatgttctgatgaagcatggataatgatttgaatttacacttcagatccacagcatattaggctatggtctcactggaggcatgtgaaatattagccatagagatgtcttaaccaccatttacatttgttttaacataaaatcagctagggtataaaaatgcacaagtctctctaactgtaaataaccacacatcatcataaatattgagtccaggaccaataccttatcactcgtagttacatctttttgcattaattcaagaagatcttgtgacatagtctctcacaatgtgatatgctaaattacattaaaaaaaaacagaaaaaaatagacaaactctgtagaggcttgtagtttcatcactgtgaatcactttcaaattctatattcctatttttatggccaactgttagtagttattcaacaacatacaaaaaaaaaaaaaaaaaagcttggactagtaccattgatttgttcattcaaaaagaatttgtttagtacctcctatatggtagccctatcctagccactgggaataccatggtgagcaatacagtcaacagttccttccctcaaagagcttatacttcagtggagacagatgggcaataaacagaataactaagctatataataagatcaattgtattctgtactatgggggaaaacagagcaataaagagagagaattggaagtggtggaagtgattgtaaatgttaatagggtaagaaaggcctcactgagcaaataaaatataccaagaaaggagacaggaggaaggcaggaaagtaaaaggttgggagaacaaaatgcgcaaagaaagctgagaaacactaatgtgactgctggcctctgtacctaccttaagctttgtgttccctctaccagtcccaggtgacctccccaaatatccctttggtcttatgctctatttcactcaccataaaattaataatttctatttccttctattttaggagacatatgaaaataatatattatacattttcactattgtattagtctgttctcacactcctataaagaaatgcccaagactgggtaatttataaaggaagaggtttaattgactcacagatctgcatggctgggaaggcctcaggaaatttataatcaggcagaaggggaagcaaacatgtccttcttcacatgatggcaggaaggagaagtcccaagcaaagagggaaaagccccttataaaaccatcagatcgtgtgagaactcactcactatcagtggcatgggggttaccacccccattattcaattacctcccaccaggtcccttccacgacccttgaggattacaagaactacaattaaagatgagatttcggtggggacacagccaaaccatgtaaactattgtttaggatatgtgtatacctttttcagaaagttatattttgcattagtgcagtaaatgaaactgcaatatttacacagattcattttgaaatcttaatcaaaaaacagtaacggtttcctttttacagttacataaaaaatgaagaagggacccacccattaaacctaccttgaatgaggaaagagattgagactgaatttcatttctgcctccagtcatgttttataaaagcggtcaaaccagttttccttacaagcagatgtccagttgtatctgtatctgcctgcctcctcaacccatcctccacaagattgagaaaaggaagacagtgtgctcttgatctggatacacatttcaagccaaagttttataaagaggaagttcaattcaatgtagaaatatctgaatgctgtgtactattttattgggtacagaataaaaggggcagcagagtaactttttgacttctcactgcatcttttgttttcctaaagcttctgcttcactacgaatgaagaagactaaaatttctctgaagagaaggaagccatccatgatttttgacaatgttaaaaccctgatattctgcttggtcctaggtattctgctgtatccctgacattctgcttggtagtagggatttgcactgtgcttggtccagaagacaaattccaagctcctacagagtctgatggctttacaaataacctagctatcacaattctaaataagtgtgaaaaccctgttaaagcacataggaaggggacataacttgtttggtggggagggagaaggcaaggctttcttgaggcagtaacatttgaattgaggcctggaaaaagagtaaaaattaaagaaacaaagaagaaatgtactgaaaaagcaacaaagtccaaaagaacgcacatccaagaaaccgaaaagtgcaggatcacaaagagaagtataaaatgtaaagaaggaataagggatagatggggctgcacagataagaaggctaaaatatcacatgtggattaagaaggaccatcctgaaggcaaggtggaggaacggagtactgagaagttttaagcagaaaaataaaatgaccaaatgtgcattttagaaagattactagttcttccagaggtctaaccgagaggtcaccatgatgatgacctgaaccagggtagaagctggaggaaaaataaaatcaaaaggattttatttcctttgtacttgagagttatttaggagatgaaacaagtgaccgatggaatgtagggaggggtttccttcttggttcactgagcacgtgcctcttcttatatctctaaagcaagcaggaatctccactgagtcctgaacaggctcaaaaagtttcaccaagaatgaatgtgcaactatcccaacaagtttcaccaagtataaatgtggttcagactcattcctcaacacatggtgtaccctccttgcagcctcccccaacacacacagctgttttattttagatgctgcaaatcataaatgtgtattacagatctaacaattgtaaaatctccaaataaagttatttctttgagtgactggaacggagaaagggagcggtgctttgtatttggcaggaacttagattagtgtcttttcagaaagcccagtacattttgattagctcaatcatcattcaacaattattctctctctgattttaaaattttcattaaaagcaaatttttaaaaaggcatacccttgtacaggagaactcccttggtattgagcaaattcatccagggatcaagggaaatacaaaatattttcacaccattatcaatgtttatgctgtagcagaggaatcagtctcaaacacaggcaaaatatgcatatatttttaaataccttagatgctatagtaataaaaatattaaaatatatatggcaaatccattaatctactctgagtatgtctattaacatgtttaaaggcataagtggtttatcatatttttatcatatttaagttacaaaaatcttttttattttaagctttttatcatttaaatcatatttttattgtagttaagttacaaaaatctttgactctcctttgaatattttcaaatcaattccataagtgaagacaaaatacacaattgaggaaggggccatgatttgccccaaaattgtcatcaaatgaatgaactcaatgacttctgaatcacacttttaaatcagatgttcccatttgatctgtcaatttctccaggtttgatacataggtgtaaaatcatcacactcttaaggcaatgaactgcaggcttaaataaatagtatatctgaaagagattaaggcaatcgtatctttcagaagaatcatatctttcagaagacatacttggtaatgagttttggactgcaagtatcagttcttagacacagcatgtgacagtttggttgcttggctaaagtttcacagcgaataattcatctctgcatcagctggaccctgacctgcaatctcattagattcattctagcccaatattaaaagtatttcttgctaataatgcaaatgccattatcatccaagtaataactagtgtctggtagtatactgatgaaattttgggtattcttttgcatttttgtccaattttcattatttctcagtgggaaagaaaaaagaaaggaagggaggcaataaggaagaaaatgagaaggaaggaaaaaagaaacggagataaagaaagtaggcaggtgggtgtatcttacaaatttgcatacatacaatagtttgagtaaattggaaatacttaaactttatcctttgtaatgtaaaaacattaaaacaaaaattctccaccatgaaaacagaaaatatatatttgtatctcctcccattatatgcttttatgagagatggttagtgaattttacacttaaatagacacacttctttttgaaacctcagttttacttggtaccaataacactgaaataatcctccactgtatcccagctaatgcttctgcatcccaccaaatacatctgaatgcatggctaaaacagaacacgtgatctggccagccttacacgtgtaatgaaaatctaaattaaagagaatgagacagcagagataaagaggatttggggaaggaataaaagagactaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtactcattattaatagaaagtgaaatcattttgatatctacaccagcagtcattaaataggcccacagactacccctggttttgcaaataaagttctattgtaatacacacatacatacatgtacacacacacacacacatacacacacacacacacggcaaaaaccaagcaaacaaaaatcatgagtgacatttattggcaactaaagttatcattgatttttgctgctattagtggagtgtttgcattgccctaacactggccaatggagaaacaaatgtggatgagccagctgtccctatgatacttaacatcatcaattttgtgtttaacatttgaccatatgaggtatttcacttaaaagtaccttaaggatgaggttctagcattgtgtgataaagtacagctcatgaaatccacataattttctggttgttcgtaatttccttgttcatagactgatgaatcaaagaaaaggactggtaagaattctcaaccatataaccttggtctgtgttttgctgtggtaatcctattagggtaatcataatttaccacccaggaaaggacacatgatagtggaaggtgttaatattaataattaataccagtacaacaagaatacatttggattcctctaagtaaacagatgcatctggtcctggtcaccctagtcaaaatagacctgtgtgtgtgtgtgtgtgtgtgtgtgtgtgtgtgtgtgtgtgtgtgtgtgtgtgtgtttcacattgttctatccctctggcctaccatattcttattcatatatcttgcaatggacccctgttatttgctaggtgggagaggagacattaataatgcagaaatttttttttccgggtatttttcatgtcaaaggacttttacactaacgttatgatatgctgcatttctacaaagttcaatattgtgcttgttttaagaaaaggaattatttgtggttttccactttgcatgccaaaacagcgattttcaatttcaaaactgttgtatgcatcggtaaggatataatttacatctattctcccttcccccttcactttctaaatggagcgacattaaaatataaattcatgcaatattaggtaagtgggaaagtaaggcctttcttttgactattaagcaaagaatacatcttaggaacaccataaatcatgcttgtcaggatattcaaaagaatcattctgtatagttaccattctattatttagaaagcacagacatgaaacaatataattcagctgggctgcatgtatctgatttgcatatggctgtatctttttaatctgtgttttcacaagatgaatataattagcaagatttaatttatctttaaaaccactgaactatgttgattacctgcaggatgacatcacccatatgcactagtagatttggactcctaaacagagcaattcaatgtattttgtagctaaacaaagtgcatactgcaagttaaaaagtgataaactagtcatccatgcaagatgcataattcatcatgaagagatcagaactgttgttttatcctgttttcctatttttttctcctaaagaaaccacaaatgatttgggatagtcaatttacaagtctgtgaccattgattaaaaaaatattaaataaacccttcagtggaactgcatggatatattctctgtacttctcccatctgagcccttcatccacctttccttcatatacgctttcaggttaagaatttttcacataatgaattatctctgacctaacattctcaaaggagcttatttgtgctaggatgtttgactttaaaggaacgataacaagaaatatcatgttaaacttgtcagctataaaataaaaagtataatttctaatacaatgcattatttagtcatatccaactttttaaaaaattgtacaaattcaaatctgtggttctgggatgttagaggctctaattgcacacaatgtaacatgataatcaacataatttcctctaaaacaccagtttgtgtccccatgaattctaactatagcctagagtaaaaacaaagaaaaacattttaataaggacaatgtattaccactgggctgattattttcccagagaaagacaaccatgaaaataaataaaaataaaattgtttgcattagaactggcattattagatatattttactcattatggaaagaaatatctggacatcgaagaggaaaactcaaaccacaaacctcataatgaactgcttctcaactgaagttgccatttagtctgactgacagtattttatttctagggttggctttatgttggtctaatctagattttgtattgaatacacacagacatagcagaatatttcacaactcctcatcaatctagatcaattacttatctaagtgcagatgaagatttgattcgtgatgtgctatttctcagagaattgtctgcttaaccgtagcaaccagaaccacaaatataactggtaacacaacaaaaattgagagttaggtcagctcatagaagaaatatacaaggcagttacgtggataaatctttagacatcaaacacatgcaaaattttcccaggcttcctgaccactctcagttttatatgaaagtgcactttaacttgttgactgatgtcatactgattttcctcaaatatcacttttaacccaccacattccatggaaaacgttttgctggccaaataaaacccaaagccttgaattcaaatctcatcacagtctggcataaactaacattttcagtctactagctcacaattttccacattgaatccttgacaagtgagaattatttcctcattccctggtgaaacatattcctttcctgtctatctttacttaagccttctctcacctggaattttgtcttcccttctatcatcaaacctgtggttctttcatctgatttatctaactctcatagctagaagtaagcccttaaaaacagggatatatctgtatgccccagcatgaaaaacctatttgtgattgattgattggatcccctcctatccaaactcatttttaggttttattgtacacaccctaccttgcctgacttttcccagcaataagtgctggtttgatctgccaggttacccttcaatgctgtttggctttgtgtcctcaatgggccatcttattctatctttagcaaacacaaagaagtcaccttaagaagaaaaacgactagaaaagaaaaacgagagagcatcataccagttccattgccctagaaaagagataaggaagcgagatattaatttttttcataattaattaataaaaatctttattgatcccctacatatctactaggagctgaagatacagcagtgaataaggcagataacccacccaccaagagcttccattcctgtgttggaggttataatggtgatggagagacacatgataaagcatcagatagtatcattattcactgttattcaggaaaagaaagaaagaaatttgaaaggattgccagatgtcaggaaagtgcttactatagagatgatgtttaagcaaagatctaaatatgagagggagccagccagaccagcagctgggtaatcgctggtatctgccataggcaacagcaggtccaacagccatgaggtgagatctcctttgcccacttccagaactgaaaatttacagtggagaaagaacagcatacagataggctggagccagatcctgtgaggctgtgggccacaataagaagttcattgaaatgggccacagtgggaggttctgagcaagagagcaccatgattctttaccttacatgagaaagaagaagaaggaggcggaggaggaggaggagggggggaggaggaaggggaggaggaggagggggaggaggaagagggggaggaggaggagggaagaggaggagaaggagaagaagaagaagaagaggaggaggaagaaagtgaggaagaggaggacaggggaaggggagggggaggaagaagaaggaggaggaggagggggaggaggaggaggaggagggggaggaggaggaggaaataaattttgggagagaaacaagatagggatttaagaggagaaatgtttgcaaatcagagagacggtacctggacctagaacctctgacatttatgaggactgggagacactctgcttgtctcttggtaggctggttgagtgcaccggcttagagagagtgtaaatgacagggagaatatgggtctacctaacactggctctctaacaataaatgacaaagacctaggtaagccagctctgaaaatctgtgatactaaaaatgttttcttcatatgtaacagtatcaagcacaacttaatttaattaattatatgacttctattagcactttataaataccctgttctaggctaagctttgtaaagaattcaggaattcagcacccatatctaatgagtatcagtcctggatacctatttgtactaaaaaccaaaggcttctccttctttgctctgattctaattttctgaccttgtatacactggttacttacagattaataccagtaatatcagttatttcgtattgcataatatttttctgttaaaaaataagaagcatccctttctaccaattcactgtagttcttcattctacatttagtaacaatgagaaactgctcattgaagtaaagcttctcaactatttaaaaacaagagactggacctcagaataagaaaaattgtgtgcagtgaaacaggttgtaatttataccaccacttcaggccatattgtgcattttgccagaaaaataaaaaataccaaacttgatggtgagcatgcaactgactcctgaactcttttgtgataaagtattctttcaagatcctaagatgcaacactaaaacataattgcttgtattaattgtcaatagtagctcataacaactaggaaactaagactttatactggaacaagctctgttttgttgcctttcaatcaatgtcttccctggaagtacaagcctttatttaacctacacgtctggatatctgagaagtttcaccttatgacttgtttcaattataaacatccattacaaccagcaagcttcctgtcttacaactactctccagctgctagatttgtaacctgcaagttattgtttgtgttaatggcatcctagtttttatttttatttctgaaaagctatggaggcaggtagaggcagagatggaagaggtggaacagcatttggtattaaaggccaacatgagcccataattatgtacatcttgatctttgtaaattaagatcaagtatataatgttgaaccctaaatgctttctattctaggatttgttcaggttcattttcctttgttaaatgctctggttggctccatgttatatatttaacacctctttcttcttgtgagtttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggtaactacttgtacctacagcttttgtgatacctgaaatcaaatgatattatttgaaagatatgagtcatgtgcttcaaggtaaactgaccttgcctttttgatcttctaaactatcatgtggaaacttgaaatttcacttttcttagtagagaagcttaaaagaccaactctaggataaagctgcaagcgttaaagcttaaagaaccgtgaatgccaccaattgtgtttcttagttgctgtaactgtaagagattgtataggtgaatgatctaattctcccaacaaaatcagtctagatgacttttattaattaaaacaattcttatcctagtatacctcctcagaggaggacaatctttttaagcttcatttagttgagaaacattctcctaaatttgatgtattttataaatgaattttttaatagcatgcgtactgcacaaattctacagcaacacagtgtattgtattttgttttctacattcacacctcccagtacatggtgacatgtatttgagagtggagagaaacttcagaagcatatctgagttcttccaggacaatttccacatctaatgtaccaattctttagaggtcagtcttgtaaaatcatctatttcattttccctgagggatgcagttatttttgttgcattcggcccggaaaaatttcactgcaaattcagtccctgacccatgccaaagaacagaatatagctacccaaaccttaagatgtttctatggtataatacatttcaaatgaggtccctttgtcatgccaccatcataattgacaaaatatacattctctctgctccacacagtatttctttaaattcacagcctttctttcaatatttgaacatttagaattgtgttgtacactgacagcacttaatgtacctgtaaggggaatgaaagagatatttggatgtattttcaaaatttgaagacaatatatttactgccaaatttgctatgtcttagtgctgccactctttactgtcagaggaatattgacattccagtgatgtctcacaaactaaaagggtggattccaaattacaagctatcttgtttaagatactaaatcactgacatcatctaaatctatttttgtgacgataaaaatactttaattataatccattgctctcagaaagttataggacgatatccaaatgagaagccatcagcttgtaaatacataaagttgtgcaagaataagttaaattactggctatctctttaggacaaattgtcaacatgtataattatacagtagtttaactggtgaggggaaggtatgcaacatatattctgccaaaaaaaaaaaaaaagcccataacattctgacaactcatccatatctctcgcctttgctgccatatctggaaatggcagaaatgcttacatttttggttctgctcatatatcagagtatgtgtgacccattaggttggtttctctagcagatttccctaactggaagtgtcatgtaaggagacatccacaaagtgtgtggtattggtgatgtgactgctatcttcctctttctctaacaagttgtattaatgcagcaaaaatcaactggaagggcatactcttgtccagaaaatttagaatgataaaaatatctaacctaaatcaatttggcaaagttgaggtgctacctgcccttgcttcagtcagtaattgaactttcctttggttctgttgacacaataacaagacctaaaagtaacttcttcgaatacatttttaaaaatttcatgtcttatccattcccattttctttatattttgtcttctgccatgtcctgagaaaaatgcctgactttagagagaatccttagatttaccacttgaaacttaaaagatcaagtctgaaaaatggatacaaagacaagtagcctttttgttggcgaacagaagaattagaaataggtagtctaaggtcagactcactttcattttcctcttctttataggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtgggagagcaaggaaagagattagctttgctaactgtctaatctggatttgtgtctctgaataacatttattagctctgggcctttagaaaaacaacagataacgatagaccttgctttagcacatatatccctatgctaagaggtttacattaattttctcatttaatgtgcacaaaaatccaatgagaaaggtactctcatgattaaatccatttgaatagaagaggaaaaataactttgccaatgtcacacagcttctaagtaccatatttatatatttaggtctgtgaacacagtatattgcttgtctgaacaatatgaaactatgtataagtaaaaaaagcatgcgggtattaaataaaacctaggtctacattctttgaccattgtttttactcatgtattttcccatgaaagaacaacatttttgccatacacattttttggaaataattttaaaattccttattttatattacatttagaattaaaagtagtcataataatgggaataataatgagagcatttcacagctctcatcgactcctaacctgagaggttgttaaaagtatatagagtgtctctaaaatatggaaatcatctctttttttaggaaaaaaaaatacttttttttcttttcttttgagacggagtcctactctgtcaccaaggctggagtgcagtggtgcgatcttggctcactacaacctccacctcccaggttcaagcaattcttgtgcctcagcctcccgagtagctgaaattacaggcacatgccatcacgcctggctaattttggtatttttagtagggagggggtttcattatgttggccaggctggtcttgcactcctgacctcaagtgatccacccacctttgcctcccaaagtggtgggattacaggcataagccagtgcgccagccaataatattctcaaaattttaattttgaagaaaataaaaatagatccaagagaaatagatcaagagtaactcacacaaaatctttctaggaaaaataatatctttttttacaaaaaaatcctactgaagaacaaattatccataattttgtatgtattacctaatatttgaggcaattgagcatcagccttcaaaaaggaaccaccccagtttctgagatcatgagttgtgccccatcaatagaacttctattgtgggcataatggaataagacgagagaagcacggtgatcagatgaagggctatagaactaaaaagtgatcaaaatacctgctgcatttgctatcacttaagcactttaattatatatctattatgaaaaattgcattgatttacatattaatattctacatttcagcatgtgccctttatattcacataaaacagaatacactctgtcacacacatttaacctacctgactcagccattaaactaaaatttgagagtgggagaaaaaagaaacagaatgaatacagtactcccattgttctattcaatgccttggattttaaatccttaactgtcactcaattgaactctatttttgtcattttgcctatcagtcatgacggggagtttaacctagggtgagccatcagtttgtctccaaaccattttttaaaatggtcttatgttcctggggtagggacctatgtgcaaattttttatatcagtctgtaatttcactttaatctcaatgactcctgggcaggtagaaaaaaacagcaagccaatttgtgcagtataccaacactatccaatagaactttctgtgatgatggaaatgcttcttgtctgaccagtcccacacaatagtcattcgccacatgtgactagtgagcacttaaaatgtggcaggtgcaactatctggtttttaattttaattaatttaaatttaaatagtcacatgaagccacagtgatgtcttggtatagtttatgtacttgcagctacattatttaataacaagcacagccctgtaccaggccccaaatttctaggtgactgtgaaagacaaaatgctggaatagtaactgtctttctctataggcttgtgtgtgaattaccagtcttagttaatgtgtttctgggtttgtttcaggaatactgctgagaacatttcaacatctgttaaattacaccaatgactacaagtcagggtatctaattcctaataggaatccttactaccatttggacaccttttgattcttctcatttgaaactcttgcattggccacagctgctgttctaaattgcctccacattcaacatttttgtcctactcttcaccttcaagctcagaaaatacactaatgcctcatccacaaaggagcccaagttcatatgatactagttctgtgaatgcatacatcactgccaccatgcctcaacctctctctactcttccatattatactcttcttgtcaacaaagatgcccatgctttttaaaatctcatcctcatacccgtgacatcttattaacccctttctacctgatctgatctcttcttcaaacattatctctgtcttctttttgtatgtccaatctttgtctacccactggcttctccacttaacataagccagcaatttttcccagttccctccactaatcacacttaacactatcataattaccatggcttacctattcgtttcccttgacatcctaggtttttcctaaatgacttctttgaccagtgacctgacaatcacctaatccaagatactttaaaaactcccttggttctttctgtagctctttaattgctcattcttatttggtatgctccatcattccattgcctgagattgggcatttttcaagataagagaaaatcaattttcagcctacaggttaagcctgctgaatttttgtatggcacaaaggctaagaacagatttgtttttgtttatttttatttttatttttttaaatttaaaagtatttcacattaaaaaaccaaaagaatattaacatttgacatcatgtaaaagtattataaaatgaaaacataattgtccaggaagtgttattataacacagccatagtactcttttacctattgtccacggctgctttcacactacaatcacagagttgaatagctgcaacagaggctgtatgatctgcaaagcttaaaatatgtattatccagtcctttacacaaaaagtttgttgacttttgcacaagatggttctcaacttttttttttctttttaaaccttctccctcacttatcattgctgttcccagcactttcatatagtaaggcaagaactaacaattgttgaatcctataagaagtcaggcactatgccaggtgcttcacaagcatcactgtatgtaatcctcaccactaaataaggcaggcaatgctactgtacagatataaaatcaggttaaataacttaaataacttgccaaaagtattgctcgatgttagctagcaatttgcggagaagacttcctagttcatttcagggagtgaatacctatgctccacacccaggctcattttctaatccctggagctccacatcattcactgcattccaacccggtcacttcctcccctagaagggcttcttttcctttgaatttccctcgccattagtttaggtcagaaaataactacctcttacctggattaggacctgttattctttaatgcctttattctcttctgccttccatttaccctgcattttcttatcaactaatccctccaaagaaatactgtctaacccatctcacgcacgtatttacatctctgcaaggatcttgtaaaatgcttctcaatttgtgatcttgccactcctctagttaaaagccctccacagatgctagttgcctaaagaataacttctatacttctttcctgttacttaagtatatttataatctggtacaccctacaacaaataaagccagtctggattgctcattgttcctcttctttctgccacttggaattcctgtcccttcatttacatctgattacttgagacaggagagtttttatccttctctccctgaaccactttcctttcatgtcatttttttctaactgcctggcaggagaattttcagtatgcatatctaatctccataactctactgtaatctcctcaaaggcatgtactcatcttattctctttgtacaaaattcctgatagcatccaatacaattcaaggtagatttttttagttgttaaccaacagctatactctcattttcctttttgccagcagaggctccatttttgtttatacagtgaaggcttcccatccccgatttccgattccccatctccagtggcttggtcataatggacctaaaccagttaaggcaaataaatggctcattgacatggaaatgagtccctcagagaaagaatttcctccttaataaaaaatgatacatagaaggaaacacccttcattgccagaaacaagcttcaactatcttaaaacagtgaggaaaagcatagttatcacactcaagctattctatggaaagatgtaaagctccttggtatttgatgacttgttttagccactgagttagtcaatcccactgcagtcttatttctagacttctcattaagaagtaatagaaattcattactgttgaagctacatttaattgtgtccattattatttgcagagtcttctgattcacatgtcaataaacatttcttgaaatttaaatatatgagtgcatgtttaaaaatacacaaacttatattgcatgtatgttctgtactcagctatgccatgtgttattattatttttcattattacataaaatactatttggtactgtttttggaagatcttcagtggaagaaacgtttcttctatatattttctcagtataaaacacattacagttgtctaacattgataggtagctagcaggaggtaataatttttttttttttttctgatttcttcccagggagttatgggcagcgaaaacgtagtagaagtatgtatcactcagattattcaaaaatgaaagagaaacataaaagagagaaaggaaagaagaagggagtgagaaagggaaggatggaaggagttggggagggagggaaggtggaagggagggaaggaggggaggagaaagggagaggggaaaggaaagaaaggaatattttgtatgcaaatgataaataggttgcagaggtcagtagcctgatactgagacaacttcagaaataaaagcagatggtagagcttttgctttttttctctcttggccacaaaactcctgctaattgaagtagcaactgaacaagctgctctttcactcccctgacaatatttatgtttcacttaggttctgactttcacattaaacactgccacacctcctgcttactccttgcttccggtatctaagccatttttttttttttttttttttttttttttttgagacggagtcttgctctgttgcccaggctggagtgcaatggctggcgcatctccgctcactgcaagctccgcctcccgggttcgcgccactctccttcctcagcctcccaagtagctgggactagaggcgcccgccaccatgcccggctaattttttgtattttttgttgttgttgttgcttttttttggtagagacagggtttcaccgtgttggccaggatggtctcgatctcctgacctcgtgatccgcctacctcggcctcccacagtgctgggattacaggcgtgagccacctcgcccggccatcttttgctttttctatgggtggattcctctcttcacatgacttcatcttgaagagaaacaaatgaataaactaccactacctctcaaagtatctcccaagactgaataaggtttcctgaaagaaggacaatgagctactgtgagtaagtgacatatcctgaatgagaaatggcagtttcctacaagctggacgccagacttgaaagaaacagcacgaaatgggaaggtcatctttaagagtctattcttatctgtgaaatatatttacagccaataaaaacaattttttaaaaaaaatttctttgttcactttttgaatcttgaaaccatggaatggaattaatgttaccagcagtaattttattgtctatcttggactgcactcttcagaactttctcactgctgctctcataagactattttttttttccctcctgcagatcagactttatttccagaaatggaaacaacatgaaaactgctgagaaatttgccaacccagcttgcccacatatttatatctgtgtcaggatacagtattgtatttaccaagattaaattatctgctgtcaaaactcaatgaaaatcatggtatacaccaaattgcactttagaaatataagcacctattttttttcaaaatgcaaataacatattgaactatgtatatttacggggttatactgtacaaaatagaaacaatataaaatacaatatataaaagcattttagagacagaaaaaagtacacggttgctaagtttagcagagagagttggatgctgaataactaagaagattctgcagaaatgggttcaagttccacatctgccactcaccatctgtgttcttatacaatcatttaagtagtcacctgcaaatcggggataattcctgccctccctgcttcatttataatgaataaatgtaaacatgtatgtgaatacattatgcaaactataaaatatatataattaaatgcaagaaactttgaaagatgacatatttgaattcccgaagtacttcaatttctgctccaaaactcaattcttctttctagaatcataagattttaaaaatgtaaagaaacttaaacattatgtagtctgcatagtattccatggtatatatgtaccacattttctttatctagtctacccttgatgggcatttaggtttattccacatctttgctattgtgaatagtgctgtgatgaatatacacaggcatgcgtctttatggtagaacaatttagattcccttgagtatatacccaataatgggattgctgggttgaatgataattctgctttgagttatttgaaaaatcaccagactgttctcactatcaagtgggagctaaacattgagaacacatggacacaaagaagggaacgacagacactggggccttcttgagggtggagggaaggaggagggtgagaattgaaaaactacctgttggttactatgcttattacctaggtggtaaaataatctgtacaccaaaaccccgtgacacacaatttacctatataggtaacctccacatgtacccctaaactaaaataaaagttataaaaatagaaaatatcatgtagtcaaactcctttattttacatataactaacataagcccagaaatttttaatcacttatccaagtttaaaaaagaaaaatctaaagaaaaagaaaattttgaaaaagaagtctagattacaatttaatctattgttcttcctggtaaccagctcccctactatttaatatagaagtgtttaacacaaggctgggcatggtagctcacgcctgtaatcccagcactttgagaggccgaggcaggcagatcaccagaggtcgggagttcgacaccagcctgaccaacatggaaaaaccgcgtctctactaaaaatacaaaattagccaggcgtggtggcacatgcctgtaatcccagctacttgggaagctgaggcagaagaatccctttgaacccatgggcagaggctgtggtgggccgagatagtgctattgcactccagcctgggcaacaagagtgaaactccgtctcaaggaaaaaaaaaaaaaatacaaagaagtgtttaacacaatttactgctttaaaaatgattttacattgatatgaaatgttttagttgtaagacatattttctaactaaaatcccattttatttttactaatcccagataggtttcagggcagatattactttcttttgaaagtgtgacttttcagaacaaggagatgagtagcagaaccagtcatggaatcaacattttgtacttcacctggtatattcttccatctttcagcaatgctcatcatattttggctagaagggattctgtttcttttaatagtgctgaatagcatatatttcaaaatgtaggacaaagtaaaattaattttgctgagggagtcttgcaataccctttgtgatgtctggagatactcaatggtatctcaaaactaggataaagaatgcttatactagattattccatctcccaaagtaatttgtctcctaataataatcataattaccttctacagtatccaaactgtagcctctttactaggcaaattatttactgcaggtaggaaacctctggtaaaaactgcttgacaatatgctgctagaaacagtctttcattttccaaatccattctgggaaaccacacaagcacacctactttcaagctcatacgtgaatataaaaggctattttatttttacaaaatgacttattacaggaaaacctagttaagtgaagtattccttgctaaagacataagtaagcagtataaatacacactagacctgctcaaatcaatatttaagcattcaacatatccacaaaatcccaagtaaaacttttgtgcccatttgtcctcttggcaccaagatttttctactctctacctacctctactgccaataaccttataggagcctttcccccatgttctcaatcagggaaggatctcgtgtcatttatatcttccaaataaatgttctaacgcaagtcccagtgttattttcacctaaagccgtatctgtttttgttagtcaagaaaagattttgctttctgtgaaaataatttcagtgtcagtgaataaattgtagcagtattacatgcttctgtgttcagtgtgtttgttgatatcatgtgttgagggggtgaggctgtggggagaagagaaggaaggaaaaggtggaggcaaactcttgtctctgatcttgaaattatgctagtcagttcctactaactacttcatgatacagggagttctggatgcatttgtgtgtgtgtgtgtgtgtgtgaaaagacaaaaagggaagattttctaaattactgacattttggttactaatacaacgctggtcaccaagaatccatggataatgtctgggtgaaatgctttgcatcctctgagccagaaactgctcaaacctattaaaattcatttgtgaatgtccattctataacaatcatcaaaacacaatttcttccaattaaacagcagaaaaatcttcctggggactgatagtgcaacaaggaaagaggatcctacaacctcagttatcacttcacagcagactcactgtggcatgttctaagttctacagccagaaacaccaaaaataaatttcctgttcttccacctggggctctattttcctactgccccaaaacctgacttctagtagaatcaaaaaaattttcccaggtcatggccaggagttaactgagtatagcacagccttctcctttctgacttccagtaggatcaaaaactcttctccaggcatggttagaagttaactgagtgtacaagaaccctgagtttttgtgtttcaatttgcctgatttgcatgtggatatacagccccagatggagaaaactaggagtgggatttatcttacatgattcactgtagacagccaaagcaaaatgtcaaccagtgaatctttgcttctagcctgtccaggaataggccctgggaaaaccttctgactgcactggaactggggggagtggacttgttctgagctgactcaaaaatgctaacagaaaatggcaggctactgcttaagcacagatgtcactttattgtgtcaacttggaaatgatcagtacaatctggcaagtgcaatttttctcacattatgagtgtgtttgagcaggtgctatgcttcactgaggtcatatattgtttccatgttttttaatttttgattcaaattataggatgaaaaagattctcaaatatagacctgtcctaagttttactggagaataaaaacgactaataaatgttttattaataatcagaaaagggtctaatgcttctccccaggggcatatttggtatatatgctttaaacttctactaaatgttgaagaaggaaaaataacagtaaggaaaaatatagaaaatattctccaaaatagatcttctggtggcttctcctatgaccacgatgcattctgttgtcattcacatattgtcttgtttggcaaaagacttgctatttctatagtcactatggaaagttgccacagctactcaaagtaagctgtcattggagggatatgcctttacataaaatagtacctcacagtcggcaggggccactgtgggttctaatggctagctttaaaaagccaaaattgtgtctgtaggatcggtggctctcttgtcctgccaaaagattgagatcagacatggtgactacaatacctccagcactaagagttgcagcttggaaacaagcaatgcaatgcagttgtagctaggttgctgggtagtatgtttagtagatgttttgtctttgaatctttctggttgcccctgaaaagttgtcacatacagtaagcataaggtagacaacagtgcactaagttttagaacatagagaaacataataaatagtcattgctttaagaaaacccttaaggaaaactacagtcaacaaaactgaatatacaaatatctgaacacaaaagtgaacattaaagacagtgttatacatgcagtagcagttctgacagacgcagagagcctgatatacaaagcaattggaaaaacagattcctagaaagttctaaaaaaggccgggcgcggtggctcacgcctgtaatcccagcaccctgggaggccgaggcgggtggatcacgaggtcaggagattgagaccatcctggctaacacggtgaaaacccatctctactaaaaaaaaaataaaaatacaaaaaattagtcgggcgtggtggcgggtacctgtagtcccagctactcgggaggctgaggcaggagaatggcgtgaacctgggaggcagagcttgcagtgaaccgaaattgtgccactgcactccagcctgggcaacagagtgagactctgtctcaaaaaaaaaaaaaagaaaagaaagattactgaaaggtcattatgtgctaggccttttccataatagatttatcttcatgttacagattaaaagaattactcaaaatatgcagactaaaaatctacattaggcactttataaaaggtatcagagctagtaaattagcagagcatggatttcaatctccacccaaagagtccaaagcccacactggatcatttatgactagaggaaaaagggaaagatttacggacacttcaactcatcctcaagagttgtcaggatttgttccgttggaagcaaggatagcaggatattccagtgaggatttcaatatgagcaatgacagcaaggcagggactagtatggcatacactgggcatgaggagataggctgattagaaagggggaaggaaaaaggagtaaagagagagtctggttccagatgacatagggtccagaatctccaaagagattcttagagctggacttaagtttggagatgggatgccgagagtatgtacaaccacttaatgtttcaaacctgacggatctagtttctgaaaccaaatctgactatagtctttattattattattattattatttagaagataaaatactataccaaactgattgtatctctgcccttatgaagtcaagatgaataataaataaatactaaaatagatggtttgatagatgtcaagtttaaatgagaaaataaggcaggaaaggaggacaaggaggataagataggaggtgtataattttatataaggtggcaagaaaaggtctcattgaagtagtaatgtttgaacaaagaactcctccttcctcagtttttttgttgcattgctgcctctctttcccccagtgtggtttaggattatcacaaacaataatcttatatttcctctaagagttattttttcctttgtgctcatatttttgatttatgaaaaggtgcacataactttcaagctatcatgatctttatgtttaagttcataccctgattttctatctgatcaaatgaaaattttcatttgtttttgatataagaagtttaaagtccatccattgtgacacaggtgaaatatgaatctttaatagatttatgtgattccacttcactctgagtcttcatcatagatactctctgtagctttttcgattaaagaaaagccagacacattaacacagattttaagcaattgaaatacagagaagattatcaaatttctagaacttctgattgttctgtatttgatgccttttcttctacagaatttttgaatttggtttttcatcagaacaccattgaagatatcacttaaggaatctagggaatttaagaaatgttaatccccgtgattcaaagtagatattttatcttaaatgtagccacttgtcttaggggtccccaaattataaattggctatataattacctatttcatggtaaatggattattagttcttttttacttctctgatttcacttcttcttcctctttttaaaattaatttatttaaaaagaaggatctgggtgtgaataagtagagatatatttcttgtatgtcttaaaatttaaaaaaattatacaactttccattgacacggaacatttaacaaggtttactttagtatgatattaaaattcaccctataattttaattgggataaatggcatttgttctttccagcagtaggtgggaaagttagaaaacagtatgtgtttcccaagagtctaataggaaaagaatggggttgtgcattttgtccaagactcctactccatagaaacaacaaatcgtctgtataacttgttctgggctttttattttgaaaatcaattattttaagtgtagtcataaatggaaggaacagggaagatgctgccatatagacataaaacagcttgatattattttggtcttaaaaatatcgaaaaaataaaaattttattgaaaatttctgaaaacttatgtaaaaaatggtcatccatcagcatctgatttggtggtttcctgcccataaggcagatacacctactattcaattctgtattgtcaaaaatcttggaaagaatcatgggatgatatgataaaccatcagctctttccaagcactgttatatgtttacagagttggatcagcatccactggtagttccttccagtgaagtctctctagtcagccttcagtacactgtcttaacatatgtccatcactgtggctatactgcatactttctatagtgaacataattgttatgaacaagtacccaagaatgagacttcatgggctcaaatctcagctctgctacttaatagctctatgatcctgggcaagtttcttgacctttgtgtgccttggatttatcatctgttaggataatactagtgcctgtaaaatattagcaccatgcctagcacatagtggtcctacatgttgcctatcattattatttctaaggtctatatatatgaaatattacaaaatccatactttaaacacttgaaataaaagaagaattagatgccacacatatccttaaatttcctttgttgtaactttttaattaagtgcacacctatacacctattgctgaagtttcaagttattcagattatccaaccagataaactgaggcaccattttctaaaaagggagaagatgaaggagggagaaatgtggagagtgaggagggaagtaccaggacttcaatttagaacacataaaggttgagatacctgtgagatatacaactgaaaatgttaagtacaattttgcatgcaaaaatctgaatatgacatgtctgggctaatgacagaaatatcagagttactggcataatgatagtatttaagggcatgagaatggatgagattagttggacgagggatattaagtgaggagacttctggaatcatgtcctgtgaaacatcaacatttaggagacaggtagagcagcagagttggtggacaccttggaagaagtcacagaggaaggaggacaaccatgtgtgtttagtgccttgttttgaaattgattaagtattgagtaggatgattagataatgagtaggatgatatctgaaaaatatttaatgaatttgacaatgtgaagatgattggtgttctttgcaataggagttttggctacatgctttcacgggagccagattggagtgggttgaatagtgaacgtgggtgactaattgacattaggttttattcataattgaaaactttcacagagcttggctgtgaaggaaaaccaagaaaaagcgcatgaggtagatgtttaaggttaggtcaagagaagcaatgtttggtttatttgtttgtaagattagtacaatccattaaataatattgacaattcaagggggggagagaaataacagaaagactaagtacttgaatagataagcaggataagacagtaagcacagttccaaaatacagtatatgaagaagaaagtggagatggtgtgaatataggagaattttcttcttattgcttttagctttgtcttcaagtacggccttggccttcagtcgtatagaaagtgtgaggccagaaatgggtcatttgtgagtttgtatgaggacagctagcagctcatgttcttattatctgtttgttagtctgaggggtggagcactggtaactaagtgatgtcatgttaccgagtagaaagggaacttcactgagaattagaattccagggtcctagtttgcaatgtgcctctaaatcagtatgtgatctgggcctaagcatttgaaaatctctgaacctcagcttttattttatagaaggagaggcttggggatcctttagaatgaccagtgaatgatccatgccactgtttggttcattacagaacttaaagaaggtcttcaaactgcagctattcacagtcaaaatagttccatatatacaatacttatttgtgttcatggactaaacatgtaaaaccttccagactttcaatatacactttataaaatctgtcctctgttgtctgtggggatttttttctgtcttatagattgccatttggaaatttaaaaataacttaaatatttgactgtttaattacaaaaatgtacctggggcataaaaggaagaattaaacataaaatttgatttgaattcttggtattatagatggactgcttttgaggagaaaactactgctaaccacaacctgttcatcaaggatttttcacttcctccttcactgcttttgtgactttaagtgtgctttataaatttccgtccaatgacagcacaatcaaggcatgcaatgattctttcattcttctctgataaaaatctttagtcttagatagctaaaagtgtagtcaaagacatttaattttagccttggggtatccattctctgtcacaggaaaaaataaatatacataaaagtaataagatttcatagaaaacagtgtgggacagagctgcctgactttaattttctgaaatgcaaggggatgcaattaactccctggttgtgattagcctcttggaagctgaataacctcagtaaattacagcacccacagaacccataatggcgtcatatactcaatattgtttacttgtctttggatttacagtcctgcagatgagtcataggatttatgcattaataatgaatcaagccaacttcaagaagcagcgctgcctctactcgaattacgtgtctgcctatcggacctttttaaagtaggtattggccaggactagtttgaggcactggctcaggggcaatatttaagaggacaccaaaaagtcagtgagtaagataaataacattttaaatcaataccttaaaaatcaaaattaatattttaaaaataaaaagttgttcatgatgaataacatatcaaaattttaaataaagacaagatcaataacagtggtatcctgagctgtactggagcctgaggcaaaagggaaattcaataatattgatgctgtctttatttaaatttttcacattttgttcatcatatatttttgcattattcagattgtttttttcaaatattgcagtaaaatataatttatcttgattactgagctttttggttcccccttaaatttaacactcaggcaagtgcctgaccctcatctcagcatttataatttaacaccaaaataactggcatgcaggaagcactgtgcccgtaacttgttcctgctgccataataaaagcagactttgcctctggaagcattccacattttaccccactaagttcttttccttttagtttccataaaagggtttattcatgtgctgtcctaaaagagtcctgctggatggcccgcaataccccacataaccaaaacaaccactgcatcaggagagataaagagtatcaggaaggaaaataaattccatatattttgctcaaaatcctggaacagttgtaaggaaggcagtcgcaaagaagtaaagtttttcaactagaggaagtacgtgaatctctcagtgcatatacctaacaaatgtagatagtcaatagcttttatccacataactcttggatcacaaagggaatgaatcattgcagtcaaagaaaaacaatttacaaggaggctgtgtccaatctcaaaaggcaactaaatgaaattctgagctctgaaaaatctgagatccgcctttattatcctcccaatttgtgaaccactcacctcagcaagactacaaactccatgaggggaagaacaaggacttcttgtttgcttatctttgtatccttagtgtattaggatacatgggaatttcacttatccctatactctgcacgaggaaataattgccacaatgtaggtggatgggtataattgtcaaccttaagcaatgacatatgaaaggactttcacagcaaatgagcaaacggtatgacagaaaaatagggtatgttagggcaaggacacctgtggcaatatttctacctagggattggaaagaggagattttctcaggagaaggcccctcaggactagggacatcccctactctttgtccattcctcctctccattgcttttctaaaagataggtcctgaaacatggtattgacattctcaatttctttatctttttaaatagacattaaaaaattcataaactgcaaggcctggtttaagttatccctcactcataaagcctaagatatttatactgtattgtatcatattattcttgattatacaccaactcatattgctcactaaagcacataaggtaactttgtgtgaactggaaaaaaaagaaaaaaaaaagaaaggtgtgccttcatcaagacacatagttgcagaaaaccgtatcaaaataatggtgcaactagttgaggtggatggtgccttttacatttttgtaatatataaattgtacaatcctatgcaatgacccttggtcactatgtctggcttttattttatatctacatagtaaagttaactccttacttccttccctccttcccccagtcccttcctccctccctcttttcactccttccttcctttcctatctccccctgcttgccccttccttccttccctccttcctttcctccttccttccttccatcctttcccctgttcctccctcccttcctgcctcccttccttccctccctccttccccgtcttcctccctccctcccttccttccttccctcccttccttccctccttctttccttccttccttctttcctccttccttccttcctccctccctccctctttttctttgttccttccttcctttactcttctttgttctcaatacttaacataatcctaaacccatagcaaatactgagtaatactttttggctgttgaattgaaatcctcctttaaaaggggagacacctaactgtgaaatcataggtgattttattttgtcttctacttgttctatattttaattgttatacaaatatgcattatttttataattagacaaaaatgatttaaacctgccaacaaatttagatgttaagtacttattcaatggccaagcccaagtaattgtgccttgtctgatttgagggaaagtgccctgcatatttacaaaaatgtattataataccatgcaattcaggtaatgcaatcctttatcttcttgttaaataaaattatctctttaccatattgctacattttagatctctctaataatgactgcaactgtcatgtagtgagtagaatggaaaatccctcaaatatcagattgcattctgatactttgaccccaaactaatcaaactaaatataaattttgacattttttctggcccttccacagatttaaaaagcaatgctgtctgggcatggtggctcatgcctgtaatctcagcactttgggaggccaaggtgggcagatcactggaggtcagaatttcgagatcagcctggccaacatggtgaaaccccatctgtactattaataaaaatacataaattagccaggtgtggtggcacacacctgtaattccagctacttgggaggctgaggcacaagaactgcttgaacctgggaggcagaggttgcagtgagctcagattgtgacactgctctccagcctgggtgacagagtgagactctgtctcaaaaaaaaaaaaaaaaaaaaaaaaaaggaattctgtcccagaaaaggtcgatctgaaatcaaattcatatatatatacatatatatatatttcaaaagatagctctgtttacatccaggattttctttgtttttatttttagaaataatcagaaatctcacttggtttctattaaaaatgcatttagctaatattcacctgtgtgagtgctgggagattcctagatttttaaaaatcacatagtaagcaggggaacgttatatatatatatatatatatatatatatatatatatatatacctaattccctaaatgtactatctatcctgcttatggcttcttcagttgaaataaaaatctcaccacaaatgaaatagagaacttcactaatttccattcaccaatgatggcagaagccccccatgggttattaagtctgagagatgtgtgaacaaacatgataataagcaagtaaagtgtatcgtaaaatatactgtgttcatttattgtgacaactggggtgtaattatactaggaaatgtactgcactttagtcagtgaaagtaataaaatttgaacaccaggagacctttctctactccgtgctattaagctacttttgaggggaaggtgaaaaatctaaaaatatagaatgaatgttcacttttatagattagcaaagcaggggttagtcagattctctggtcgtctaataaataaaaactctgttctttcctcattagctgtggatacaccaccaaagaacattttcctcaatttctgggtaattataatgcctaactttatgtggattgcttatgctattcatctcactttctccctccaattaaagaatagaacggcaaaaccaaacctgactccattgtattgtaactgcttctacaaagctacaagtagaaaagcaggaaaaaaacgtgcaaaaagataaggaaacaaaggggccctcggagatgataatgttgcacaatgaggagtaggtgtaatgattaaagcattagtggtggtcactaggaaacgtgaaaggaacatgtaatttcagattaggaaaccctgagcttcccagagtgaactgctatttgggaaagtgtagttaattgaattttatgacactttttactaaactaaaatgcatatcttttattaccctaatagtttcattgctactgtgatacttatgtgcagtgatacactaaaaagcatatgcaacaattcactaaagagcaccggagtggattattaccgtttccttttgtgctttggcagccgacaatccagatcataattacaggattggagccacctgccgactcactgaacagaagcacgtggctccacataaaatagagcaattctaacactaaaatatacaaaataaaataaaataaataaataaaagaaagaactatgttaaaccaaagagaccttcaggaacagcctatggaaagctggatatttattttttcatgaacgccaaatgactgactctcacattattactggcccagaacgaagcagagtttgccaagatcttcctggttaaactagatcatctaatgaaatatctgcatcccaaattgactggtgaattcagaccttttatggtcaaattcacaataaatctttgattttagagcatattatttctaatgcatagacgcaggaatgcaggaattgtcttcacttgtataaaactgttgccttggcatgcatttagcctgctaaaccagtggagattaccaaaaagtaaaagtaatgtaaaaatggtgaagtcaagaaagtgaatccatacagaatttttctaattggatattctcatttactaaacaagttaatccaaaagacgacattatttctttctgaatttttccaaatatcactttctaagagaagtcttccctcatttccttaagtcgacttagtcactccttcctctgccctttttacatgcttctattagagcagtgcttcttacacttccatgtgcatatgaatcatctgggatcttgttaaaagcatattcagagtcagtaggtgtgtgggggagggaaggtctgtgagtttgcatctttagtaagcttgcaggtgctgctgatgctcctggtcctctgaccacattaaatttcaacttttattttaaatatgggagtgcatgtgcaggtttgttacatgggtatatgtcactacattttgaaaagcaaggtattaaattacttcataaattgtcccataatgatctgtacatgtcaggcatttcctcttgtgtatgagctccttgaaagcaaaggcaaaggcagtatctcaatagctaccaattatataattcctactagttttggggtacagggaggatgttaccatacatcatctttaattctcaaatcaaccctgcaagatctgtaattgtgtttccattttacagatgaagaagctgactctcagatatgttaatcaacttgtctatggccacacagatgccatgtggcagtcagaatgcaattctggatctatttgtctccaaagtctgttttttctactgcacctgaagcctcatctgtttacttctgtaaatatagagtgtagcaaagtacctattgttatagaaggtgctcaagggatgtgtcttgctctgtgatcactttatatataaattcacctttgctcacagtatctcccttgtgtgaaatgctcttcctgcttctgtcttcccaattaaggtccatctcacttccaacgctcatttctacttagccagcacacaattgtgcctttcctctcttctgaatgcacacggcaatggtttgcagcacacaatgagcacttaaattgttagttatcttattaacagtatatttacttcattccataaatatatactgagtatatattaaacaccaggcatggttggaagcacttgtgataggtcatggagcaaaacagaaaaaaaaaaaaaatcccttctatcctgggtcttggaaataatttccccaactaaaatgaagacttctttgaggcagggacccaatcactccactttctgtatttctcattatgttttgcacatagtaactgctcaattaataatagtctcagtaaggtaatttaccatgtagatatgttcctaatatacagagtggaactacacacaaggcctttctcttttctcataagttatccttggaaagtgaaacgatgctttcacgctgtttctcactttcctccaactgcgttttaggccagaagcagaggtattaaagtcacacacagtgcaggtatcagccagagagacagaattcactaaaatttaatcatagcagcttttagcacaaaaaatatcttttcacaagtgtagaaattataggcaggagagataacctcatgaaaagttactttcactagcaaatatcttttttcctttacactccgaaacaattgactagaaacctgctaactaggagaagtcacatgcttaaaatttcacaatattttgttgtcgtttgagtcaaggtctccctctgttgagtgcagtggcatcatcactcactgcaacctccgcctctcggattcaagggatccttctacttcagcctcctaggtagctgggactacaggtgcatgccaccacacccagctaatatttttgcattttttgtagagacagggctttgccatgttgaccaggctggtctggaactcccaggctcaagcgatctgcccagtttggcctcctaaagtgctggtattacaggcgtgagtcaccacgcctggcctacttcacaatattttgttcaacaacattttgaatgtgcactatctgaaataaaaagtataaatgttttcctggttatttgaaatgctccattttctacttcacaaaaccatcatttttaaagtctgctcattcactgaacgaggtatacaaagctattctttttgaaggtatagctcttctaaagcttcattaggttgttagtcacatgtattaacatgtacaggaggcagacctgcagatgagcaatttagaagggaaaatagtactcaccttgctctgcatcggttcttcctcatttttgcaatttcttatgttaaataaatctacatatattaatctaccttgtatacattttaaaacatttgaaagagaagaatgcagataactcttctcaacttagctattttattcaatactgagatatttcataacacgatctgtggatggcagaaaatggaatttgaaatgagttctaattcttattaacatgagaacacaggcatacatcttaagtacagtttttgtaaaattgatgtcacaatttttattatgcaagaatgttatgagaagaaatatatttaacatatcaaatcctagtttattgctgatgtttagttagtagtagtattcctgcctatattaacacttacacatacacaattatattactgttttttaattatgaaaaagcatttatttacataccagtaataattacaccagcatttagctaagcaagtacacaggcatgatctctgcattcgcaaaatatttcaacttaaagttgatgtaagtagatatctgaaagaagttataaataaatagctacataaacatgaaagaaaaagaataggtgaagtctttgccctgtgtctcaggattaattcaaagtttccttgctgaaaagaggaagacatcccattaatcagatttctttttccaagttcttcctttttataggaattggcaggaaaggtctttggctaaaatacagcttaagattcgtgtactgtggctgagctgtaggctgcatcctagaagagccttaaacataagtaaaaataggtctgagggttgaggaaaaagaagagaaagaatatagtgacaatgaatcacggactcttagctctacagaccttaaagacaaggcaaaccaaatccctcattttataatgaggaaactggggcccacacagctgaagtgacttgctcaaggccacatactgggattacagccgaagaatctttgcatgtaaatcctatgtgatttaaaaagaaataaatatgaagatcttactagatatgggctgctaaccagatgggaaactgtgtttggaattgctggtaaactggaatcaatttgtttagcaagtggtaagaatatacaaacatggggaatgttttaggcaacgaaaaagaatgtcatgtgaagaatatgtacctaatataaatggcaattttgacagtggttctgttgattcaagttttttgtgggtttaaatctctttacagacaaggatgaaactttaattctcaatctatataaattatcaggctattatttcaaagaacacaaaagaatagtaatagagaaatgtacacttggatttggtcattctcctcacactggagggaaaattttgccttgaatagcatgaataatgagaacaggaacttttcaaacattttcaatattgccagccaatgggagaggctgataatcaaaatgaaattttgtattcttttcaaatcaccatatattaaatatccaagatagtattaaaaccctctcataaatgttgccatgatgttctatttacaaaatttctttgggaacaactttcattctattaaagtctttcattatctggaaagcaaagaactaaagaaaggactttaaagataatctaatagtctaatagtccttcaatgtaagggtatattagaatcatatggaggctcctaaaacatagatttcagagcactacctcccagagttcccggttcaggaggtctggggtgagatctaagaatatgtatttctgacagattcacaggcaatgttgacaatgctgatccaggtaccaccgtttgggaatgactaatctagtcaaactatctattattagtctaattaccttctttttgattcaggtagacaaattctagtattcttggaacttattatttaaactttttttctcaactcctccaacaaccaatttgttctgtttctgatgttgtcactatactcatcacctattaagctgatttcaggtatattctactaaaatattgaaccaaaacaatcacgcaaactaagtctcttgttcttggtacggttgcatatataaatgctatcttttgcataattaatacggaaagaaaaatcaccaagaacattttcaattccaactataccacatcaaatggacatttgggtctcctgtggcttctgcaaagggaacacatagagaattcttcagggacactggaggactaaagcagagcacagaagtgatatgctactactgtaagagaaatgggattattatctccagagagcttatgttattgctggaaaaatacttcaagagtgtcaaatcttaaagcttacataaaaaagatcaaataagtattgtagcatttcacaatgatctgatgattcccgtagtatcagctaatcagtgggaaaaaagtaaagtgaccaaaaaatagttatcttgaaatgacaaaatatcctagcagttgtcaaaattaatatgataatatacaggccaggtgaggtggctcacgcctgtaatcccagcactttgaggccgaggtgggcagatcacttgaggtcaggagttcaagaccagcctgggcaacatggtgaaaccccatctctcctaaaaatacaaaaagcagtggggcgtagtggcgcatgcctgtaatctcagctccttgggaggctgaggcacgagaatcgcttgaacctgggaggcagaggttgtggtgagccaaaatcatgccactgcactccagcaagggtgacagagtgagaatccatctcgaagtaaataaataaataaataaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacacacacacacagttaattaacggatcctccaagacaccaatcttcaaatattactgagcatttaataagtgttatgagaaataataccaaaaacagaagaatgagataataaactacagatgagaaataaagacttatacacataaaaagacaactctagacagtaaatatttgggttcagaagcagaagaaccatcaagtaatcaaagactgcactactctggatgaacttgatgtgagctggatcatctccacaggctgaattttcttaggcagagcggaaggagggaaggaagaggacagcccaaatgagggcatcatttagcagggatgaaggcataaagaaaaggtattgactacaccagtgtgtctctatacttctctgaatcaaagagttgatgccagagcatgtgaagaacaaagcatgctgtagagttgtcgcataagattgtggaggaacttaaatgtggaaagaataaaagaatgccagaaaaactgcatgttaacaaaacctactgacaacattagaaaaggaaatattgagatagtggagagagaattttcctggagacctcaaaaccataaatgagagataatactgaagacctactccatttggctttacatggccatagctttcagggactcagataccgtaggcactgaatgtcaaaagagaggttgcatttagaactcaggcagcagcctctcatactgcactctatagatcaattttagtttaatgagatttaattttaaaatccttaggttttatctttagcacttcaacacactgaaaatgcttccaggttttgatttacagaattactgtcactgtcaataaaagaaatgtgcctgacacaccaaaatccagtttaattacttctgtaatgtctcctgcagctaagaggaaatggtatttctctgacacttttctgtttttaatttagcaaaatggagcactttcccttaataggacctgggacagcagattcagaattgatgtcatcaaagatggaccccacagtttcagcaacactgtcttactctgactgtgcaatgattgcatgaatctggatccttggtattggattccttgaagctgggcactcatcaaagatttgacacggaatcatggctgggatatttagacattatgtcatcacttggagaagctttgcaagcaaattcaacagcctgcttctacctagaactcttaacaatgtcagcattgccctgaactgctggaatccagatgaggccttgaaagcttccaaatagaactgccaaatatcaaaatatacactgtaccactggagtgaagaaaccaagaaaaaatgtgtactttatatcttctgctacatattccatctgcttctctccctaaagggtcatatgttatatatttataagaagtgttcacacctacgcgaacagtttccactgtctccttcaaatacagcctcctccttgttcaagacccatttttttaaattcttctatggtagctgaaccttttatgaaacttgttccattctgaaatcatttcaagttaagaaatgcccttgtaccttcctatctcaccaaatcctggggagattaagcctcacactctataggcctttttctgagagatgtgaatttagatcattagggtcattaaaatcacacaatctataatactcagagctaacatatcacctttgtgctttatgctgctatagaatgctacaagagagttaaaacacgtatagcatcacagaactgtagagaaggccataattcctccccataaaagaattctatactttttaactggcacagtaaatctcattaaagacacagaatgctttgttcagggaagcaaaagggatccctgggcaaggtgcgtttccttcacagtaatattttttttccttatgacttgaattattccttaatgcaagcacaatgttatttttatcttgaccttttttctggactctacatgtttccccaggctttttttcccttccctacaaaaatgaggggcccttggtcttcactattaatcttgtattaacttttaatacactgggcttcatgcatcctcttgtatttctctgtgtatctaccaaagaccttcataggccacactaataacctccgacttagtctttttttctttctgcctcaacaactgtataaagaataaactcaggtataattaacataataaatcatttggtgcacattcattggtcaacacaattctgaatcttaacagttaatttcccactatacagattgtgaatctgattcacataaaagtactttgggaagtattttgtctgatttcactatcaaatattagattattatttttgagaaactcagaaaggctgtcatggaaaaatcacagaaaattcccatctctctttcataatcagtacctttttaataacagagctggaagttaatgacagtatgcttttgacagctcactctgaaattttaactcatctgtagaagtgccaactgagcagttgaggggaaaagcataaggtttaaatttacatctaagaattaagagtgagaaaagcatggaaaaacattacacagtgttaaagtgcacttattactaatttctctagggaattttgcagctagggaatttcagttgcattattattgaatctatccccctttaacagagactgtgggtacagaaaagaatatggccttgaaggcagacgcattcaagttctgtttgtgccaactactaaccatttcagcccaaagaagttacttaaaatattcatacctcacaatcagcaaagggaagagacaatctaaagaactggagaaaatatttgcagactattaatccaaagaaaaagtaataaccagaatacataaagaactcaaacaattcaatcataaaataattataacaaataattgaatttttaaaatgggcaaaagaagacattcctcaaaagaagacatataaatggtcaacaggaatataaaaaaaatgcttgatatcactaatcatcagagaaatgcaaaaatcacattaagacatcaaaatcaaaatcacaatgagatagcatctcactccagttaatatggctattataaaaaagacataaaataacacatgctggcaaaaatttggaaaaagagaaatgcttgtacactgctggtggaaatgtgaattagtacaaccactatggagaatagcttggtggttcctcaaaaaatcaaacacataactaccgtatgatccagcaatctcactgctgagtatatatccaaaagaaaggaaatcagtatatcgaagagataattgcattcccatgtttactgcagcactattcacaataaccaagataagaaatcaacctaagaatctgtggataaacggataaagaaaaaaatggtatatatattccaatacgagttgaactggaggtcattatgttaagtgaaacaagccaggctcagaaagacaaatatcgcatgttctcactcatatgtgcgagctagtaaaattgacctcttggagacagtgaatagagtagaataggtggtaaccagaggccataaagggtagaaaggtggagaggatgaagaggggttggttgatgtatacaaagataaagataagtagaagaaataagagtagtgtttgataacacaatatggcaaatacagttaacaatattttattgcatatttcaaaatagctagaagagtggaattggaatgttcccaacaaaaataagtgataaatattttaaatgatggatacccaattacccagatttgatcattacacattgtgtgcttatattaaaataccacatgtaccccctaaatatgtacaactatcatgtattcataattttttttttttttgagatggagtttcacttttgttgcccaggctggagtgcaatggcacaatcttggctcactgcaacctcctcctctcgggttcaagtgattctgctacctcagcctcctgagtagctggaattacaggcatgtaccaccaggcccagctaatttttttgtatttttagtagagatggtgtttcaccatattggccaggatggtctcgaactcctaatcttgtgatccatctgcctcagcttcccaaagtgctgggattacaggcatgagtcactgtgcccggcataaaattttaaaaaatctatttatgcttcagtattcttctttttacatttaaagtaatcagatatttttggagaaaaggtaaagcttataaaatttaaatggcatgcatataatacatattaattatgatattagcactgaaatatgttgatgtaatctacataaattttttgtagttctttttatgcactagctaggcatatccacagcaacaaagtatagaaacaacctaggcctgatctaacacttctttccaaatccaatcataattatattattttaaaataaaagatttcataaattataaggtaattatgtgtaatcctatactttaaaaacactcctgataatttgatttcataaagtgggagaagtatttaaccgtttgctctcttcaaatatcttcctgattaataaaatgatactaagtatttttttacttttattttagatccagaggtacatgtgaaagtttgttacataggtaaacttgtgtcacatgggtttgttgtacagatcacttcatcacccaggtattaagcctagtagccaataattattttttctgctcctctccctcttcccactccaccctcaagtagactgtggtgtctgctgctcccttctttgcgttcatgagttcacgtagtttagctcccacttacaaatgggaacatgtggtatttggttttctgttcctgcattcatttgctaaggaaaatagcctccagctccatccattatcccacaaaagacattatctcatttctttttatgtttgcatggtattctatggtgtatatgtaccacattttctttattcaatctgtcatactaagccatttattatttgtacttatttggtattgtgcaaggttctgataattcactgtgatttatcttcagtttgttcacacgggcttttggtacatcatttttagagaagtaaaatctatataaaaagtaaaattaaacttaatggctccaagtgtcaacagttagcacctctgattaaggcagtatccccatcctgccttgattctgcacctgttgtgttgctacagatggaagtaacatgataaacacggatatataatgcattcgcatggaaaaaaaacattcagatgaggctatctatttgaatagcatttagtgataactaaaaccattgtctttccttgagaatagttagtcaaggtgactagcaaaacctcctctgaatgcagctctggttagctgggctctggtgagataggatagtgttaccacagtaagaccaacattgaaagccacctccatatttacctataagatcgatgatgaagagtgctaacatttgagccaaattaaggtctacacagacagagttttaatgaagccagaaaaattagagcatactagcaggaaaatccataggtgaagaaaacattctgactgggtttgcttcctttttgatttctaggggccaaggtggcagaattcacagactaaaaggctgctgagagttgaatcatcaagctgctcaacagtgcaagggactaacatagataattcaaatacagcattactctattcccttttttgttgtttttctccccacctaaattttctcatatagatacagactgaaactattattcagctgcccaacaataatataaaaagaccaatgcttccatttatgcatctacttttatgatgtcaattctaaaaagaagaacaaagataagtttacgtaaaatagtagcagatagcacttctatgacatattacatttctctgtcatacattatgctttattttctgtccttcattacattttcttacttagtaggaaaaatattttaatcctttatcattcacctgaggcaggtctgaccctgtttccccatagtttttttaaggtgttttcagtaaagattgcttatgaattgctttaaacagcttaagggcttccacttagaaaaaattcaaggttaataagattcatcatactcacaaagagtatctggttgtggacatagctacttgctaaattttattcagccctaagtgacaccagcagcaaatcagctcacagcttaatactactggcaactctaaatgggagagaagtaacattactcagatccaggtttttaaaaatatatgttatgattcacttccattagttcatatattgatgctcagacactggatattggattctctttcaaacaacaaaagaagctgagaaacaaagctgaagatatttttaaatgtcatggtaaaaagtcacagggaagtgtattttatcctcatttcagcgaatgtttctaactctcatatgaaagatacaataaattcctatcagaaagattttctcttggcaaagtttaggattctgaaaacagccttttaataaaacagcacccacaccctcctaagctgtagcaccaaaataacagcactatgttatattcttcccttatggtaacagacactgttgaagctgaactgtaatttggcatacaacatttctatactaatgtaatgtgacaatgttattatgttcgctattttgcatacggtcatagccatgttcatcttctccaacctgacattaagttagcttaatatggtaacattctattccggaccactgggtaaaaggagaaaaggattattgtgtagcacactggtgtgatgatggtggacgaatgtgtaagtattaataggtgatatataaaatttacaatgaatgtaaacttttagcacagaactggcacatagtaagtgctcagcaaatggttacatccaagagaaatttcataaacagctacaccatacaatgtagtccagcacactgtttcctacaatttcagaagagggaaaaataatgtcaagctcagaaaacaaaggaagtttccatgggacaaaagagttttagtagagattgaaaaggaaattatatttcttcaagcagacatagtgaaagaatgcattccaggtggaatgaatgcattttccaggtggggaaattagcataagcaatggtgaggaaattggaaagtgtaatgttgttcagaaagctgtaagtaaattggcagtaatatgccatatggacaaggttctgcaacagataagtatgaacatgaaggctggggtcagaccattgaggtccacgaattccacattgactaacttggagagtagtattggacactgaggatatatttgaaattcttctgcaagatgcatgtgtctagcacgctttgattttagtgagttattacaattacatgcagcatgctataaaaacactgggcttataaaccaagaaaacagagaagaatgttattcctagtagaagtatagagtcttatagggaggtaagactaaacataggtaactataaggaaaaagtgatggcaaattaaatagtataaacaaaattctataggaagccagaggagaaaaaaaatattgcctctggttaggagaattaggagagactgatgacatttaaactaggaagaatagaaagaaagaacaaaactggcagagaggcacagaatggatcagaggaaagaggaataagaaatgggagataactaagaaattacatgatataccagaaaaattatacagaggatctaaaatttggtattgatatggaagaaaacttgaagaggtgagtatatgacattaccctgtacacacacctgcatatccacatacacacatgcacaaaacaattgtttttgtcagtgagtaggtcacttagatggcaattttccggggaagaaagggtttaacaaacatttcattaaaaatagcctttggcatcattttgaatagcacttctttttgaaagattcctttcagttcaattaattagtatgatttatccaagattacatttacaagctacaaagtattcccatcttcccattgttaattatatctccaggctaatataaatacattttttctagttaccctaacccactctataaaccttatcagcgagatgacatttagaaattctattttgggggagggaaggtctcatttgtaatgtggcatgttcgtttccccattaaaaagttttgtttctattttcttttttgttttctatgtaattggaggctgcaatcacagaatttatgaaaaaataaactagagatgaaaatttcattaagaagtgaaatgccttaaatggctttattttaaaagaaaaatcagcttctatacagaaaaggagtttgttaaaaccccaggaatcacactaattctatttgtgcatcttagagaaaaacagtgagatgtacagacaagatttattttgatcaatttaaaaagtgaggaaagtgttgcatgctatttctattgcttattaattccacgtcttcaaagtaacaattgctactatatcttctaccaattataattgatacaaaataagatttgcttttgaatattgatttgtacctatgtattctcaccactgaaactccaacgtataagccaaggaaccatttcacattttcagaaaacccactaacaggtaatgatttaatcaaaatgcatgtattctgagagctctctaaagtaattttaatgctgatttgtgcaagaggcatatcaggagacacatttattgaatgacatttacctatttacaagaaaataacgaatagccttatcattgtcatcaccagtactatcacccaagagcagcattaaaatagttttctgtaaaaatcattcgaagacagcatgatacttatggttgtatcttggtgtttctttagggaaagtctaacaaatacatacacaaaattatattctttatatttaactggtatatgaggatacacagtctgccacaaccaaatggcaactgtatgtaaaacatggaaactacattaagcatagtttggcagaaaaagttctttagcaacatgaaaaatattttcacaccaaaaaaatccctctcaactaccacatgtagtcatacatctgtcaggattgtattcaggatgaaaaatttgcgataataaaatcttaacaagtattcagtcttctgattgtccttgaaaataaatttacgccattttctgtgaggcaggaacaaatgcaggaagtaatttacctatacacacatatacatatccttatgaaaagcacatgtaaggctgctatatgtatatatatttattaagactttatgtaaagttgtttatataactcaaaatggcgttattgtgttttaagtgtgatttggcttgcagagtgttcgcaaatgtatgatagtttgaatacatgtttattgcttcaggtttactgtaattctatgggagaggaaactagtaaaatgaagaacaaatatttctccatctacagtggcatggttgttaaaggcctcttccacatatgttttaactctgtattggttgtgcgtttttccaatagtcaatattttggaaaggaaacctaaagacagcaggtaaattgtactttattgctaggctgcaacaactcagttcagaggattactgtagctttaccccatcttctacattgcgatgcacatatctgttgacatgaatacagtctcaaatagacaaaggtcaaaatgaacaagctctactctttctttaaatccacattcaaattcagcctctgctacaaaatctaaaccttcaaccgttgcatcttctattccatcatcctggaggtttagcttaagtgttgtagcactgacaacatatagcacgtattctattttacaaccaggtcaatttgtcaggaatattctcttaatatagcagaatgcaatgttttgtatgaaattcttttatcattttgatgatgtgctgtaaatcaggacctattagaacattaagacacagaacttcatcttatagatcagttaattccatcttcaaaccctcactgctgtgatataaattaggcactagcagatatgccatgatataatgtgaatcatgtgttttattttcatgcttatattgtaatacttagttaaaggattttaaggggaaaaacataagttgctaagatacaagggagaatggctgaagggacaatgtttgaacatatttttttaaaagtaaaaggcagcaatgggcttaaagagatgtacgcagagagaaaaatgagacctgtaaccattcagtaaaattacagccctcgagacataatcatatgaaattaagtattatttaatataaaacaatatgaaggttctttcaaaaaccaagggagaattgtcatatattggaaatgaaaaacattcttttgaacaaggtgatcattagtaattaaaaaataacaataaacccaaaaaccaaagaatcaccatcatcacaggatttagccactttaacaattagtatttcaaaactgtcctttccgtagaaacaactgcttctatgggttatgacagttcgactgactcagagttaatataaggactttcagtgttagactttagatatcaaacagtaactggaagcaacgatgagtatcagtccatactcagagaggtacttacggtcattgcagagtggtccactgaaggaagtcatactacagtcacagctgaagccatcccattgttgcaagcacacaccttgattggaacatgagtcctcttggcaggttgtgctgggccctgcaaaacaatccaaaggaaacttgggttctttaaaagaatccaaaagcattttatacatgagctagatcacatgtagtagttgccaacaccacagatgatatgtccaaactagtttttaaagttctagttcacacacctgaattaggaactgagaggctgtaatatgaaggttttcttaagtttcaagtataggataaaatacattataatcataaactaaaccaacaaatagcaaaaacaagcacatagcttctagtatgattattgtagcaggtaatctcattccaacttcaataattctttatcactattttgattttagaaaatgaatggatctccttaacattctgaccaatgaatagagacataatgagaaatggagattataacttcatgaaattgagataagattggcaaaataactgaagagagttatgcaaaaatgccctagaggtttccaaacgataaagttatgattgctgggtgttttgaataggtatgttggcaagtatcaattcacatgcttttaacaatttcatgcaattaaacataaaattaaaaactccatataaatggcatgccctcaataaacatacaagtaaaaagaatgctagtctatttctaaagaatcataactagaacactgaaaaacaaagaactaaaaaaagcatgatcaaagcactaaaggcaatcactatacaaacatattcaagactgaaagcctttatacaaactatgctacaaagttaggcttcttgcacaacgttcaagaaaggaaaagaatgaaatctgaacccaaataacagttactgcagaaatgtaaaatatgttattttagggtttccactgtgtattatggggtttcagtcttgttatatacacacagggctatctaccttgcaagtcagctttcatcaatgcaactttgtcagcaaaataaaaaaaaaagcaaaatatattaaatgttagtaagcaatactgaaatggggcaaacacagaagaatgttcagattcaaaaggcatgctgctgtaaagagggagaaaaatgctatgtagagcaaacaaattaatactaacagccataaatcttaagagaagccaaaaatgagaaagcagaaatttattagaatttaattgtacatatgtatatatataatggttaattgagccaatgacatgtaatgaaggaaaattaaaagggcctttgtatgtttcctctcttggatagatatgaatgcattaccaaagtgactgtgttgcttatttggaacatgcagcaccattcatcatgtgcagatacagtgtagactatgatcagtagcaaagcaattatccctttctatgtttttccctctagatcctttatctttctgttgcaattaaggcttcaaaccgtaatgccagccattcactgacaacagctggactttagagtgacaccaaccaaatgctgcataaatgatactgtatatcatttagagtggatgaaagaagtaggaaggatggaagaaataaactgcaatataatccatcataaaggaattttctgaataaaatttccatgtgcagcgtttatccttgaacttaccagattgggtatatgccacttatgaatttcagagttacgtctgtattttctacactttcacaagtattttcaactcttataaacttccctgtggaataactgttacagtaaaacctcactaataagaacctatcttagaggagggtgaaaagggaatacagtctacctaaatagctttagagtataaactaaatatattttctagtaaataaacatataggttttataaaaatagaaaaaaagacaacagctaattagatgctattaatgtaaaagagagagcctctgaggtgcctgctttagtgaataaattagaattttctgtaattatattttgtataaatagatgattttgaaaatggcttctaaacatgtaccttacaatcacatttgtattataaatttttagtaaagatactctttattgaatgttattgaatttagcctagcctctgagaattcacaaattcagaaaccatgatattgtaaatcttaattctgtaataataataataataacagcaataattgtaacaataattaaaacaaaaatagtagtttatataagtagtaatataataagaagacctcccaaatccaggaaacctgaagagagtaacagttgtttttttcaacttagttatttgtaataaagaactaagaactaacaaagaactaagaactaacaaagaactaagaaccactaaactcaacttagttctttgtagtaaagaaataagaaccacttaattgcttagttttaatttttgttccaaactgtgagagggaagtggtctactgatccttatcccatggcattagagatcaaaaataattagcatatttttaaaaataaaatctctcaaagcaatattccttagcatatttcttccagtgttaagcaaataaacagggagtaatacaagcccagtttggggagatgccattttatcaaatagctatttgctctctgacctgcacagcagaagaaaaggtcagaagcaagaactaatgaagatccagattttggtttttgttttttcaaaaattatcagaaatgcaattgagaaacaatgctaaactctaaaaatagtaaaactacaatcttagaaaaataatctgcccatattgtagagcagcaactcagagtacctgccaagcttctatgtaagcatacagacgtgctgtattttattttcattatcacaatagtctttatattcaggaattacaagacaatgcatgcctttgcctgacaagacacatttttcaaagtactcaccttctagacaatacttaaacattgacaggtattacacaagagagagccttaaatttatttttctttttagttatgtaatattatctttattttatcactgaataaaattaggaaaaagctacaaggacatttgtattaagttatttaaattaataatatgtctaaaagggaaagaaaaatgaagataaaactacaatttccagaaacaaaagaaatgatacacaaaagaggttaggtgtctctgctttcaagtaaggtaaacttgagtttgaaacttgtgtcatccacttactaggtgtgggactttaggaatgtcaccttacttttctgaggttcaatttactcattaaaaaaaggcaatgatacctattgtatagagtcttgatgatttaatgagatagtataggtaaacatattcccaccagtgtttaatcaatgatagctgtcacgattaaacagaaaattattcctgtagatataatggagcctagagctgaatgttacagttgtacaaaaagagcatctattaaaatttcactctgattttatgtagagatattatcttgactttagtgggcctgcttattggttgaattccagtgcccattttctgctacataaacagaaaaaagccatccaaagtatggtctccagtataacagcatcagcatcacttgggaacttgttagaaatggaaattctagggctctatctcagatctattgaattagaaaccctgggggttgtaatctagtgatttgggttttaatgattctgtaagtgattctgatataggctaacattcaggagacaataatctaagtagacttcgacgggttaaaatccgtactctagctgaggtgaattttataaataaaatgaaccattactccctgaaataaattagaaataaaaggcaacaagtgattatttaggaaagatcaaaagttttttgtatgcaagaggcttagaggtgtgtgggtgtattggataggaacaatggaaactcctcacaagatattattaggttataccaaacatatgctaagtagtcctatcaatatggagcctaagtgattccagtgtggtttggactcaaattccatgacataacaatctttagaaagagaatttattaggtatctacagttaaaacactaatcctaaaaaatgtgtgaatctcatcaactgtacctgtaacaggtaaatctaagattattcctagaaactatacaggtcagaaataatagtaaattaaaagttgttcaccttgatgttggaatgaaagaatcaggacagaaagtaatattctaagagtaaagaaaaaaaggggtgtcagggtgtgaaaattataaaagctcagatatataaagcattctagataaggaaagaaccaatgccataagtgactgggttcaaatgttcaaataatagtttaatgtgtaactaatcatcttaaccaaattccttactagattatgtgggtaaacaacaccaaacatcattactgcaaatgccctttgttagtatatcctgctcctcttaatctacttgcttccgcccactcactcacattacataccagtggtgggggtcctgtgtgtttgcctcttattttctatctcattgggtatatctgcctgctctcaccatttcttgtaggtgagaagtcacataccaaacaacttgtagaaaggcctatttttaacaaatatgttccataagggattgtaatacctttctttaaaaaataaaataaaataaaggtacacattctcactaatgagatcacctccaagaattattatgttgtatcacattcttgtgttcatccactaatgggaattgatccccttaacaattttgtctctcttaattaaaattaactgaaagggaaaaaaacatagtttccttatgttttacagaggcattatgccaaaatatcaaataaagaaatatactaataacattaaaaatgaactcaacaacaccttccattactaaccttatcctctagtattactgaaatacagtttaaatttcacctaacatttcatggaaacacatgctgcacagaggaaaaaaatgtattttcaaatataaaatttccatgtacttaagtaattgctaaatataacgacattattttggctgagaataaatgattcataatcacctgggggacaggaattcaaatttctttcttcttctctcatataaaacatcctcatcctcataaatctaaaattttcaaaatggcccaaactgtgttcagtattacaggagaggcagcaacacatgcagagccacaaaattcatgataatgtgattaaattacatttatggaggaagaatttgctcaaataatctgaggtgttgaagtgaaaattatctaaaatgaaagtggcaatcaaaaagtactcctacagatcttggtctgatagagagcacaaaagaaaagaagatacttcagtgcatttctgatataggaatattagcctggggtgatacaagaaacttgtttttgctaaaacagactgaaaatatacaggatacagtgtttctgccaggtacacaccaactgaatagtgctttgagaatggggtatctgaacttttttcttttgttatatgctattggatatagatttacttatttttattttactttttttttaatttcagtagctttaggtgtacaagtggttttcggttacatggatgaactatatagtcgtgaagtctaacatttcagtgaacctgtcactcaagtcttgtacgttgtacccaataggtgttttttcatcattcaatccccttcccacgattccagcttgtgagcctccaatgtcccttataccatgctgtatgcttttgtgcacccatagtgcagctcccacttataagtgagtaacatgaagcatttggttttccattcctgagtcacttcacttagaatattggcctccagttccatccaagttgctacaaaagacattattttgttctttctatggctaagtagtattctgtggaatatacataccacattttctttatccactcattggcttttgggcacttaggtagattccatatatctgtaattatgcattgcgcagtgataaatatatgtttgcagatgtctttctgacatagtgacttctctcactatccttcacaaactaatgcaggaacagaaaaccaaatactgcctgttctcacctataaatgagagctaaatgaagagaacacatgaacacatagaggggatcaacagacactggggcctactggagggtggagagtgtgaggatggagaggatcaggaaaaataactaatgcgtactaggcttaatacttgagtggcaaaatcatctgtacaaaaaacccctatgacacaagttgacctacataacaaacttgcacatgtaccccctggacttaaaattaaaacaaaaagaatgtagatttttaaaaaatgggcacaagttgattaatactcggtggagcagtatttgtttaatgctataaagcaagcatcgtagaactgattaacaaactaatcaaatgtactacatagctcaaaaacaaaaacaaaaacaaaaacaaaagcaaaaacaggcaaaaaaaccaagatccatagatatacctcccattttacattgggcattaatgtaggcttgcaaacagtacagaaaatttaaggtttatgagataaaaaattaaaaacttgaataaggatgtctaagcccaaattgggtatttgaccagttatcagaattttgctggacagtgagattcactctcagttagacaggtggaattagaattatttagagcatgatgacaaaaatctaataccttcacatcctctctcgatctgtccgttgcagaaaagagcatcggagatgaggtccggaagccgtccatttaaatcaactgatgccaggcagccttgaaagccttctttggcatgtacaagttttggtaaggatttgtatgtttctttagctactcctcctatatataagtcacctgcaagaagatcaaagtctttgttacaaaagtaccatgtcattgactttaaacacacagtaggatggagaaaaaacagggaggtttatttttcattaagttaataaaaaattaatttatgactagctgttttccccaaagtgctaaacaatagagacgtttgaataatatactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagagatctctgtgtcttccatttcatcagaagttcagtaaatttcttcttgtatctaaagtcacttctatactaggctgaagcccactatccttgcttgcacctctcttgttcgataattcacataatagtctgtacataagtggatattgcatccttcttgaggtatttctgtttttaggtaaaattacactactttcaatttttaggctgctctgaaatccgttaacaaattttcaacttatttttctaattttattgcagtttctaatggaagacattgcttagctttgtttaactttttctctctaggtttgagattccccaactttatggactattacttaaaaaaaaaaagagattacaatctatgttggattctgtttctttttctatttcagattatttaccatatctggataatattcaataaacataactaagtgactttagtaaacatttaatcaatgtggaacataaggaaggtgagctcaaaattcagtaatatgctgctatagctccagtctacaagttctgtaacatactctttttatctacttcttcaactttcattttcatttgaactttctttctcatgttaaccattctattcaacttgatgtcacttggcacattttccccagtgtaacacaaaaatcctgcaatcttactgttcacctgggtccttctgtgttgtcttcacgagacttgggaacaaggagaactgatacacagactgttgagctgtgagtaacaaattccttggtctcccatccagaaatattctgtcttctgcaggcacccattaaacagtaataagctaacctattaatttgtatgtagggtaaaatcaaaccacagatataacactcttgaactgtactcatgaataaattgaaatagaggaatcatgtggcatactcaaagtcattcaacgttaaaaactgagaacttaggtccttgacctaactaaaacttaagttttataactatataatttgcattgaaagtactggatgtatttacttccccccttttacataaagcaaagtctactgactattaaccatcattcttaatattaaaagacagcatggttttggtcagagaggggatactattttgaagaattatttgatttttcttccatatttccattctgtcctttgtttttgctctcacttaaatttcaggccattgtgttttagttgcctcagagaaaggatatgaatcagaaatcaaagatacaaaattagctttctgtatttaagtctaaaaatcctagactcttcgaggaatgaaatagaatacattggagtttacataagaaaagtaaagctttcctactcctctttcagtcaagcaggagataaagttggaagaacctagttgtgcaagtacagtcattggcaaatgtcaaagagggtgctgatttctaatttaaggactgagctctggtgaatctcaaaacctcaggtaagtttcaaggagtaatgcaaacctctgtgcatttcctcaggagaactaagagggagcagtgagagctctgaaaagaaatggctgcatggtggacttagataacctgagaccttagacagtctcacacaacgttccgtactcctctgtgccatgggagctatagaacaatttccagactggcacagaaatagcaaaaaaaaaaaaaaaaaaaaaaagtccaacctaaagaggtcatgcacacaagaatgaagatgctgggtagcacctcagtgagcacctgagttgtgactctagaatatttgaaacaagcttccatgccacctctctttacccgcccgcccccctaccaaaaaaaaaaaaatgagtacagtagaactcaccccattgagttatttagatatgacacaagaaaaagaagggaactaaaattgcctgagattgtaccttcactaactcaaagaatcaaagctcaaaatagaaaccaaggtgagttatagaaaaatagaaaagttacatttcttgtacatcagagattgtgggctgagatttataatttgacatgacaaatagcaatgaaaggaaatactacctactcctttcatttgttgaacaaaatttgttagaaaatttcagctctcctccaggactaatgaatgtagtagagtggggaattgaatgaagaattcttggcacagctttaggcttttcagatgtagaactcagtaatagaaattatgtatagaatactatatatttattaatcaatcttcctctgtctgactgtaacctcctgaaggagagagactgtgtttcccagagtgcccggtactgggctctaagcacggttggccctcaataaatattgtcagccaccttatggattgaggccacggtagaaaagaataaaaaaagaggaaacagtaaggcaacacatgaggagagtgctaattctaaaatgcaccaacttacttccttttcccacttcctaccacaatccctatgtttttctattaaaaaacttacttgcctgacaacattgtaaagcttattgaagagaactagtaatctttcccttgagttactaaagagcagaaaatatcagttcaagcagtgtgggatacaaccttcaaacatagcaaggtagacgaggttggctttataaataggggactcattctcattttcattactgaagctgtacttagcaccaccacttagtactgtttataaactctttgatatagcaaatagtgatctaaagtcccttggtgggttgccacatgaagagaacaaagaaactcctttagtggtctgagccctgtgtactattatcactttatcaaagatgcaggttctctttttgatccttgaagtgacgggtttaaaaaaaaaaaatgacccattagcactaatgggtcctgcaggtgagtccctgtgcatgtgaaggaggatatacttaatggctctgtgtatgaacaagagcctgcatgggcaaccagtaaaagccaactttcctgtagatatgaagctagcctgttacctcttcttcaaaatgagtggctgatttttaattcatatgttttaaggaccatgtaggcaattgataaggcaaaggttgaattgggacactttcagcaaaagaagtagagaacatgtacaataccaaaaactcaaaagtctaaggggtgagtttcttaaaataatctcaataatacccttatttttagtactgtatatacacagccactatgttcctctcaagagtgttatctgtgaatgaactggggtgatatcatgagtatccattccgcagtaattgagcagtaatgactagggaatagggcacaggcattttggttttctctgtctacaaaccctggctctgccacctactggctgtctcagtgtaggcaagttaggttacataacttctttaagagtcagattcttcatctatgaaatggggttgataatgcctaccttgcaaggccataaggattacaaagtatgcacataaagcatctagtatacagcatggacttagcccgtcattgatactggtatggctgtcagtatatctgtaaggatgacacatctatgatgtacctcaatctatgctgattccactgagaaatgcagaagaaggagaagtatagtttatctcctgtttctagcacaactggagtgacaacatgtcaattttataaattctccatgatattttttctattggatttagttgacagtcatttgtgtgctgaagtgtgccttacactattctaaaagtagctcacagagctcctttgacttaatttgaaattcggtggcattgaatctggtaatataaataggaaagttgcttgacaaatatcttctaatttgacacaaagcgattaagaggacaaaaaaactctatgaagcccaagggccaggttgtcagttccagactaaacatgccttagaaaatcagagaaataacaggtttttgtggactgtggttgcaaagtgggggagcatacaaaagttgagacaagaagaaagtatgggagacattactattgtaatgatataaatgtggatgccagacacagggaacagcacaattgtaccatggagacaaaatttatatggcatttaggaaagagaataaaaggcttgactggaagagaggagttttcagttatttattaagttatgtaaataatattgtataagtaaagtcaaaggaaaggccaccatagaacttatgactgctggctgaaaaaaataaataattaaagataatgagaaatccaaggatcaaagcaaagcaggctaggaaactagggaatttgaagcagtaataatccggaggagaaataaaattgcatttaacgtcatgtatgtggaatttgagtaggaacatcctagaggaatccagtgatatgaacctgggccttagggaacggaggttggagcttagaggccttccttgggagccaccaaccaaaagcagacaaatgacgcggtagagatttcctcttcacttaaaataggaagcataaggcaattagagtaaagaccaagctctgccttacagtagcagaatgcaagtgtcaaggtataattagttctttgactcagctttcctgtttattcacatgtacttttttgaacctcttaaatatctcactttcattttaatttttttaaaaagcatacagaaaaaggacaattgccttatagatttgaatagctaaaactccaggaaatatgaaggaagctctcacaaacttttataaatggcatttggggaaaaagaaaaagtgaagtcacacaaattagcttactttcctatagctggactagagaaagtgcaattctagacacttcattttaagaagattggaccttggagagaaaatttgggtgcagctttttctcctaattcttattgtgattggatggtaaaagtagtgcaatcaagcttgggtagtttctgagcacattctatgggaagggtgcctttcggggaacaatcaacctctgtccccaaatttgtaccattatctttaattttaatattgtattgcacacacataaaggaatatctgtaggtcagaccttatctagatacactgagagagcttgtctttaggtgacaaatccaaacctctaaaacaggtgttccctgttagataaaagaaaatgacctataatatctgataaacaaacatttgtttgctttcttagtagaaagcctaagtgtgactgcttaaataaataatattaaactactaaaagaaaaagcatgggaagtgaatactgctctaatctatttgagcttacaagtaaacaaatataaacttctataagaaaccacacagaaatgaacaatgaaaactatacaagatcatttctaagttcaaggcttgtaaaatattcaaaatggaaatcaaatgggcaattcaagcagacattttgctctgagacacaagatctgtgtctgtaataaatctccattttttaaaagattaattttagaaactctccgctgaagagatgttaagtggtcaccagcttgatttattgttttttaacttctatacatcttagtctcccttggtacataaaaggtttagccttacaacaatctatttttgcttctgtaggaaataaccataaattattatctttaggcgtgtcctgaatttctaggtccagcctaaaatcaaaccttcatcatctcccttgctgtgaaattactttttctaaactttcatgttgtgtaacagccacatatctagtctacctgctctccagattggaaattcagtatcatttttaactttattttatatctcacaccttacaatcaactactgccaaggggtgaatgactcaactttgccaatatttctgacatttgttgtttcgttttcattcccatttccagttcttatctatttttcttcttgtacacaccttttaagtactaacctgttacctggtgtcactgtctccattcagcctcctcatcaacactgtctcagtcactccactgtgttctgatatcttcaatacctttctgtatcatctaaattaagtctaaggctcagcagtgatcaagattttgaattacttctcttcaaaaacttttgctaaactttgaactatctttcaaaaataacttttgccaggtagaagattgaaataatatctatcttcgccccacagtccgacctttagtcaaactttgttggcagcctttccccaactctgcattttcccactgctccatccttgcttgtggtatacaatacttccagcatgaatgcctttcctcttctgatgttgttcttcaaaatcctactcaacttgggggactcaactcaaactccaccttggaaatgtgtacctgtttccttagccacagataaatatcttggaatcctcataaaaaattgaaccccttttctgaaaatgattttatctttttcagttctttgtatgtgtaagccttatgtaaccattagtttatacattatttgaaggaataatcctaaacacgtttatattctcattttcacttagtaagcatttgataattagttgttgactcactgaatgaatggatgaattagtagttcacattcaataaataatcattgaaacaataaggacacagggaaggttttatgtcagcactcatatttgtccctggctctttttacctgagcaataatgaattaagttaattgtggaaaatttttcatctactaatccatttctttttcttttttttttttttttttttttttgagatggagtcttgctccgttgcccaggctggagtgcagtggcacaatcttggctcactgcaacctccgcctcctgggttcaagcaattctcctgcctcagcctccagagtagctgggattacaggtctatgccattacacccggctaacttctgtatttttagtagagattgggtttcaccgcgttggccaggctagtctcaaactcctgacctcagatatccgcccgccttggcctcccaaagtgctgggattacaggcgtaagccaccatgcccggcctgatccctttcttaaacacaaaggtgaagccatccagctcattaagaaaatttagggaattcaatggcatattttttcccactctgatagtgtaacttgatagagtaatacatgaccagttttaactgacacatactgaatttatttgtagaaagagatacagagatgaagatagaggtgtagaaacagtttggagtatcagtgtgcgtagtaatgagaacccatgcatgaatcgtcttctccaattaaaatatgtacaaaaatctttggaggaaattaaatttgagcctatcctggccttctgtttcattctggctctatgctgctccatatacaaagatgacctgattcatgcatcctccataggcatatggacaccatgagcacttcacactgtctctccagactcatctgctctgttattatcacaaagaaagacatgcatttatttgctgtgtgtgtctgtagaacacagagaagctaactgtgtggacccttagtgctctgctctagtgagtttgttaatcctcatctgcacttccttttggtttgcagatgtttcactccttctagcctttgggccaccactcaaagactcctaaggttagagtccttctagtttgtagcttctatttcttggctccttgtcagccacaggtgttcctgatgctacagcaggcttacacatctaacagtatattgctttagctaaaatgactttgagtttcacaaaaatcaccgagacaactgaactgaaatgtacagagtcctgagtgagagaggtcttccttactgctttgaatctttggtaatcagtgtcaggcattactatggtcaaaaccagaaaaaacagctctgacttcatcattataataataactgacatgagttaagtatccttaacttgaccaagcatttgcacatatattgttatatctggtttttgcctgttgagctacaagaggagtaaaggttatcagggatacatgttacagatgaagaaactatggtttagggctacaataccagaacagggcagggtcttattgcaagcccaggtcttctgaaactatgttaattgtccgttaatccagactgacacgcacatgtacaccctgtacactctaagtggcaagtggccaatatgtacagcttcactactacaacatacaggaaattttggagagttgtggctagttgataaaagtaatggtaataaatggtagcaaaaatccaagcaagctaacaaattcctgagacaactggtacaataagagactcatctgcataataatggagtaatctcataaaggcaaagtcaattttcttccataattataaatattaggtattcaaattctgatacataagtagaattcttatgttcaaaactttttaaatcaaattttatcaaaatgttttttaccaaaagtcaacatttgatttttagatacagcagttacttttcaattgtctcccacaaagagataaatcagacacttgtatgtatccatggcccaatctagtacaaaccagcacttacgtgggacaagttggggaggggcaaccccaagaagataagagtttagaccttaacgttttcctgtagtgagttttggggagttaatattgttattatccatatcaacagaacatataattctttcaatattctgaacttttgtttctttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccgaacttttgtttcttatttaaattttgaaacaaaactgcccccaaaaagatttttttaaagtatgattctgaaacttacaacaggaagacagattttgtttgtatgtttggccaacagactgtgaggaaacctggtgggcatgctaaatgggaaataataaagtgaaattgctatgggagcgtgtagagtaatccatcttcttttaaacccactctatgccagtaacagtgtggcagatggggtgcgagttcagggatataaatccatgccaagctaacttcatctaatggctttaaatttttaaatttacctttaggtaaaaattgggtacaaacagtttcagttttttccttttgtctcatccaaatgacagccagtttaaatacctgtgacattccttacagcagacaattctgtcaccattccatgtttcattttttttacttactgtgtaatgctctctgggactgcatatggatttgcaggggttttcaacctcacatatactgctgtaccttacacatgcataaacagtgcagtttgaaaggtgcttttttcagaagcttttgaaccagagtgactccatcttgaataggggctgggtaaaataagactgagacctactgggctgggctgcattcccgaaaggttagatgttcttagtaacatatgagataggaggtccacataagatacaggtcacaaagaccttgctgataaaacagaatgcaataaagaatctggccaacaggcgcggtggctcaggcctataatcccagcactttgggaggctgtggcgggaagaaaccccaactctactaaaaatacaaaaattagctgtgcgtggtggcatgcgtctgtagtcccagctatttgggaggctgaggcaggagaatcgcttgaacccgggaggcagtggttgcagtgagccaagatcgcgcccatgcactccagcctgggcgacagggagagactccgtgtcaaaaaaaaaaaaaaaaaaaaaaaggaatctggccaccaaaaccaagatggcaatgaaagtcacctctggtcatgctcactgctcactatatgctaattataatttattagcttgctaaaagacactcccaccagtgccatgacagtttacaaatgccatgtcaacgtcaggatcagaaagttaccctatatggcttaaaaaggggaggaaccctcagttctgggaatttcccactcattttctggaaaactcatgaataatccaccccttgtttagcatataataaagaaaaaactataagtatactcagttcagcagtccatgacgctgttctgcctataaagtaggcatttgtttgtttctttacttctctaataaacttgccttcactttactctatggacttgccccaagttctttcttgcacaaggttcaagaaccctctcttgggttccggttcagggcccctttctcgtaacactttcacatctcttactccatttgatccttgttgcaacccttcacaataggtagggtggttattattatccctacctgacagatgaacaaactacccttctgaaaagtttagttacctgcccagggtaatacaagcaatacaagaataataatgccagcacttcagcgtttgactcccaggctaattcttttctgatgcaccacactctctcctatttttactaaaacccttctcaatgacaggagtagaatagatagaggagtttagaaatgactgttctggaaattaaaagagactgataaatagggaacaagtagcagaacttatgtaaagctgttattttttcccgaatagtgtatagaacaattagactttctttcccaaaataacttttcttatttgaaagacaggtttttttcttatttcaaaacaaacgaacatttattttgggtggggaagacccagtggtataaagggcaaatataaaagaacagctctttcctataatacgtctctttaatgtaggtgaaaaattggcaccggctctcaacttagatataaacaggataaaaaaggttatagccaccagtggttttctgtgtagcttgaaaggacaaagtagtataaagcacacacaaaaaaacttacagacattgccaaagagctttcaaaatattatgagcttcctggagtcaaatcacactcttgtttttccttaagtatctgaacatttctgtatttttttttccaaaaaagaattccttctgtgctcgaaagatggaatattattaataccaataaggtcatcacatccagttgctatagtgtaatttcctagtgcatgtctccaaacactttgttcttccaacataagctattcttaaggagaaatggagatacttaaaagcagggatccctcctccaggtcagggaagtgttaggaacttttcctaaaggctaaggaaattaagggctttgagagctgaatgagcctgcaagtagccagtttgcaccagccgatgactgattgataggccaacccccaatcacccaaccaagtactagattttccagagcctattctacatacctataaatgcaaatgttctgcagaatatatataaaggacacacagcaattaaagttgttagctgtattgtttgaggagaacttcaggggctaagaagacagaaccaatatatagatgctatgcaaggcattggggagagaagagcatatagaaagtaaagtggaaatatccagttcctttgcaactaccagaagtggaattttcaatgttatacaatgtagtagaaaagtagaagcttgattaagattttttatggaatagaaagtgttttattttatgatatttccccccaagattaaaataaatgttagcttttcactgtagacattcagaagtaatcctttcaaatattttggcaaatacagatggcagtatttaaatactgccgtagacctgggttcaaattctgtttctattgctttgtgctacgtgacaaatgaataactcacttaagccttccaagtctccattatctcatctgtaaaatgggggcactaataattcactgatctaattgttgtgaggattcagagaccgtatgtgtaaaataaatactaaaattgaatttctgactgaagtgccaacacagtcaatatcagacaatgtgagaatgagacagacatccagattcaaaatttatcaaggaacaggtgaaatactggttctaaggcccttgaacccctcagctacattaaggaaataataaaaataaaatggatcagaaatgggaaggaaaggtgtctgagaatattttttgaagtagctcgtactatgcagtgagtttgtgctcctacattctagctccaagcctagcaaggcagctctcagaggagggtctcctggagtgcttgctttgcgttcccgaccactggaggatgcagaactggcacccgacacgctgagaaaactttaaagaggtcaagatggaatggaacggaaatgagagcattgggaatggggtacacttccaaggttgaggggacaaaggatccatggaaactcctcgtgggccgagataggccccaagtgcatgacagcaagctgggcaggactgcctagagacaggtcagcccatgtggtaagagtctgtgaggagggagcagaagcatccccctacacagggattaaggttggaagttctagcagaaaagccttggatgaacccaagaatgcaccaggagaggaggaattcgagggatctgccagaccaagagtcccaacatcagttgatgtgccttgtcaaaaagctgtcgaaagataattgcaggaaaaggcagtagccgaacttgccctttgccctactgccagtgactgaccaaagcagagggcagcctcaattctgagctttgattagtaactcagattggtggtttgtaattttaatgaatgttatgttttataatataaaattattatataattaccttaacagtgaacccaaacatttactctaaatcagtacgtggtacaaaaccttaacacaatacattttaaagtgatcggttgcggtaaaaccaaaaaatgatattatagcttgaccacattaggacatcatacttatttaatgtaatgctttcacacataagcccttaacatgatgcatgacatataggcatgcataaatgacataattgataataacgaggatgatggtgacaataacgaaggtaatttattatatctttgaacagagaatacagacagacccaagccataagatagtttttctcacgaaaacactcagttttctacaataccactctattgatgtgcatgattcacacatgtcgcagccaaaagacatttaatgtcattttggatatcattttgggaaactgagttcattgggtttcacaaaaaatatcgggaactacacatgttaaatttttaactgtcaaagggctgttgtgttagagaaagaatggtacactagtacaggcccttatagtgtttgaattctttttacagtcccagaactctaaggggaagccagtggtgagaggcctaaggagtctgtgtattgtgggtaggggagtgtgagtggggcatgaggaggggagagggaggagagaacttcccacagacaggttaggaatattgataactaacatcatactagtcaacctctaataaacttgagatggcaaatgggctctgcttgtactagggtagttatgggaaattggcctaaatattgccaacacctgtcagatccaaatgagccttatgagccctcctagtcctttttatgaacccttgagcatcaaagaatacactggcaaaccttgtgtattgttctgggaattaattgagatgagataccatgtgcaaatctttataacagtacatgagatacgacgaacccttagaaatggttacaataatttctatttagtattactatcattattgttctggtgagatgcttaacctccccaagcctcatgttagtttcatcacctgttacatggtgataagaacagcaacttcatcagtttgtcacaaaaattaaagagaaaatatatgtagctgtcttacctaatgcctagtaaaggtagatgaggatgatggtgatgatgatggtgatagtgatataccctgcctaaggaaatacacaaaagaaatggcagagatgctatttcacccaggtctttctgacgtcaaagactgtattattaattataatgctatatgcttcttgtattgtccttacgaacaaccaaaataattaattgcaaaggccaaaaaggggccacttttaagaatggacacagaaaaccacattcatgtgatgtcaatgggggacgctgattgacctaatgtggttcctaaggagcactggaagtaccctctagtgcatgaaaataaagagccacaacagtgctatgtcattaaaaatgcactttcctgtgtggataaagatggcagatttagcttttgagcatttctaccgtgggagcagcaactttgttttaagcccacccaactttcaagtctatttccatgttgacccatggctcaagaggaattgtacagtacccgggatggaagctggctttcttctggcggggactgtgttattactgaaatccaactagatgagacaattgcctgaaaatgatagtgacattcccttttgggaatatagtaaacaactgtaacattgcccagatgtcagcctgggcccctttgtccattacagatctagatgagtctggttaggaccctcgcatctgcacagaaggtaaaaatctaaggtcctccttcttctggcatttcctgtgaattcctgggaacctctgactattgcttggctttgctacctcatgtactccctatgtataaacaaagtctctgtctccacccaaaaacaaatgctgctcactcaagcacttatgagtttcatcatctaaacatttgggtatcacctagcacctagtattctatcaccttgaagaatttaggccctatcctcaccccctactccagagcaaggcaaaccctgtccctgaattcttgcatagcaggttaaaaatcacactttttgagcctttgatatcttcatttataacccaagtagcctatccccatatttctttaaacaaatccagtaaactcatatttgtataatgtgactctgtctcttattccctcaacctggcacagggaggacatctgtcttgatcaaatgtactcttccaagaatttggcactagaactgctaaacttaaacgagtctttcttgggtgtttgagttgatcaggggtgaaaagccaggtctgagaaggccaagtttaccaatgcttgtgaaagcagagaaaactagtgtgcagagcaggagaggaacaagggaatgatccttgggcagcttttgggaggcagctcacagccccagtagagaccaagtgaggctgcaacactggcttattgctaagagctttcctgagtacgccttttatggagcccagcattgatctttctctgttcttgtccgtgggttcctgtaatgctacatcctgtctccctgtccctttccacatcacttgtcagtctgaatggttttatgctactgtactccaaagacttctgtataagtctcccttcagcaaaaggagggaggtctgagagctaggaaaaccctgaagatttaaatcttacttgaatgagagagatattgtcagatatctgccttctcagatggctgacaaagacagctcttgaacaagaagctcgaattctaagaagacaacgcatcaccactcctggcattccctaaagagggacctgcaccaaaggctcatctctggatgacgatgaggtcttgtgagcagtcacctgacctttgagaactcagctctgagcacctgcaggtacttgctgctccaaggcacaaatgtcaccaccttgaagagctcaagccatctaatcaccatcctgctgggacgtggtaaactgtcagcttatcatgaaaggcatctgggcataggattgaactttccagtagcccacacttggcgtggaaaagctgaagaaagctatttctccctgtgcacaacctccttgtggctgttccaagcatggaagccaaggcctgtggctgtcagagttcagctagtgtgctgggtgagaagaaaccagccccagggctttatgcatctgcaaatgggatgggttgggatctttaaagtttcaccaaaagcagagtcaataggtggcactctcgctaccaatctccatcttgggcctgtgactgaacacaccaataatcttcaccaatgaatccacacaaaggtgcagatttcttttcagtgtgttgctgcaggttgtcactagcagtcaattgagattgatatgagcaacgcaacttctatcttctgagctatggtaaagaaatgtgaaactgggatagctgtgcaggtcaacctcccctgagcagatttctctcatctgtaaaaggaattggtcacaccagacaatccccaagatcacttatacttcctaagttcacgtgattctaatggtgggaagagagatttcaaataatatagttggagggagttgataaaactaaatatagacaacccatggttaatgtcagaaaaattcagaaacaagtaaaatgggtgaaggaatttttaaaaaatgcttttagtagagaataaagaatttacactctgctgaaatactgtgagctgggccaagaaccacagggaagcagagggaagaactcccaaaccaaatgttggatagcaggtcccagataactgcatgggaagggaatgttttaatcccactctcaacttcccgcctccttaaggtaggattaaaacacactgacaaaggctttacagtacggagaacagattgagacaaattctgcaaaacccggggattcaatggatgtggcagaagagaaacagtttcacatctctgtctgtctttcaagtaactgctctaaaattcttgtgtaaggaaaggagtaacaatatatcaagtcttatttctacatactcagaaacttattgtctttgttctgtaccatggcaattgcctcaaaagtggtgtcttttccctgaacctcggctcatccatcccattgaagccaaaggaataattctaatgagcattgtgaactctcctctgcttctcaaaaccctttaatttcacctttcccatcttctggcatggcgttcagggcccttcaaaatgagaaaattaccctgctcttttgtcaggggttacagacggccttccaacccatagtctccttctcttccctttcaagttcaaaaagctacctctgtgtaattgtgtaattggactaaagaagtgagcctagccagtagcagcaggggaaaagcttatgaagttatagcctagacccaggtccacacactgtattaaaccctgtactggggggaattggaaagtgagatgaagcagtgaatggacagaagtggaaacatacacaggaataaaagccataggtgtaagccacgagacagaagaagccaagattggaagaagccagcaggcagagaggagccatctcacagcagtgccagcagacagaatagagcgagggtggctgcactgctgtcacggtggggcaatggattagggagcagtgaacatgtgtatccgagggaaaaaccaagaggatggctcttgagatcccagtatgactccaagaacaaagttcttatactctgtgaggcctcattgctcaacagctgaaagggtttcttgtctgtcttacttcctactggatccttaaaataatctacaaatggaaatagtgttaataaatctctttcccttatatagactaaaaaaaaaagtaacctcaaacagcaacaacaagaaactaataaagatggcctaaccacaggacagcaggaccttccctccacttccggtgccatatcctgctctaacgttaagctcaacatcactcttccctgaatattttctatttaaacaaagtatctgggcaagacaagtgggctgtcagatgtcctgtgggctgaatgtacaaagcctgggcatgtttaaatgtgattatgactttgaatagaatctggtttactgaatgacagcagtaaagatttgtcaagtagcaacatgaaaaggtataaaatggaggggatatgtgttatattcaggattggagagggcagggagctgagtaatagcaactggtcagagatcaagaagaaaagagcaagaatactatttatcttcaaactttgcttagaggttgagtatatttgaaaagaaagtccctgttgagttgtttctgattagggacatttaagtggcttcgtagcaggatgaacaatagcaggcagttgccttcagggtgagatttaaggaggaatactaggaaggttgaggaggagataaatgggtgatgatcctggtaagaaggaaaaggggcaagatcagaagacaatgaagacaatgccagagctcaaaatccttgaaggagttttgggtttgagagggagaacagaggaggaagaaaggacaaagtactgcctgggctgacctagatgtggcccataaataaatcactgtactcagttttatgtagttttgctaggtggccacctgagggcactctatgctacacagctaggaatctttaattttccccctatcaagtaaactatatatatcctcaatttgctgaaggataaacttagctaatgctttaaagaagggtactcattgaaggtgggggccaaaagcaattcttcctccctattttttccctcaactagattaataaatgagcaagactgacctcaatttaaatccctgggtaattgcaaggattaaatacagtaacttcagttaaatctatttagcatttagtaggcacttaataaatattagctccctcccatatatatgcacatcctaacatacaaatttgccaaatacaggaacaagagaaggaacacaaggaggaatcgcaccaaccatttatctctctaaagaaggcagggctcagaagtcctaaaatgaatacaaagctaggctaggaaatcattccagagagcaaatttctgctgctcctttcattgcatgttgctgcttgtacataataaccagagggaatagaacacaaacagctgggaaataaagatgaaagcaaaactgtatcagcaggaagagacacacaaccccctgagaatcgagcggtgtcatgagagataagctgaacaaggccagctgcatggaatttatcttctgagagaaagatcattagattcctacccatttctgatcgtttctattggagtcaaggtggagaatgaaatacatgagccccagttttcaaagttctacactaaagtcctgttcctataatgaaacagagccacggacaaaagaatgcatcactataaaagccaactgtggaattttagatgtctgaaaacaaaagaaattctacttccccttgcaaacggagcaggttgaggtttccccaactcccgggtcctatgcagcatgttttgtggccttctgctgccctctagtgtctttttaaggtatggtaaaacataaggaggataaaaaaaattctcctaataatcctaaccagccaacaatgtgacttcagcccagggctggtaaaacaaacaaaaaaacagtaacattctgaaataaaagcaaaaccaggatttatacaaaaatttaaaagtgagttaaatttggcctcaacatagatcttgcattatttcaggactctgaaataatggcatctctatcagtcaatgcactttaaaaagaaagatgcctgttttctgtgcatctctctcaaatgattactgccttggttggtctgagataggatccagaaatatgaacttcgcaaacaccacaacatgattctcaagtagctaaagttggctgaccttcttttgagaagcaccaaagatggctgcaatgactctcagcaggatggagagtaaatctgatgttttctttaattctttaagaatacaatctattgaccaaaacaggtcaactttcatttttcctgcagctcagtgctacatgattagtatgcaaagaaaatactgctgtccatgtctgagcgaagagttcatgtagaagttctcctttatgaataagtccctctaaattccagcaggcatccaggtggaaaaaagaaaaaaatgcctcgttgctcttgctcacccttcaaatatccctcaaacattactgctgcaaaaaagccttccaggtggtcccagcttggtttcaatgccccactacagctccacagcacctaaaagtgctgtccttctctgtcctataagtgctccctcaacgccagtgttctcatagagacggagagctttgcattgcagaaaccctgttgtcctctttccaaagtcaatgctccataaatactcatgctctggccaatgcccacagccacccttacccaaagtggtgatgatgggagacaagacacatcaggccccacagcaggctgttctcaaactccctctagctgatggtgcacatgataagaggcaccgtgggatgactgttgccatcggatcacatacccaatttgttagctcaaacttggactaattttagaaacttgctcttacttttctgcaatgcagaaggtattattctatactaatgattagccccttcacatgggaaattcacaaacaattttaattgtgctttttaaaaaaacacaagtacactgagagttcattactatatatcttaatactatgtaatatgccatttttaagttcatacttacagtgttttttctttattatgggcaaagcctgttttatcttcagagttatccatcacttaatgctttaataaaaataaactctgaagtacttaggtgtgtaagtacccccaccagaaagaatcctagtctacaatctcctattaccttcacttccatttgttaatgaaaaataagcagatatttacttctcaggagacagtgtcctaactatctgaagaaatacaatccattgtctcacacggcttctctggaccctcaatgtgtagggctgtacatgccacatacttcaaccaattataaactgctttttttttagccattttaatttccaacagagtatccctaatttccagtgaagttcacttatacttactgacgtctcacctacacaaacagggcactttttgctttagctttggtgactcgatcagcacactggattttacaatctctccctttcttttgacaattaccacctgagcccactgtgcaaaacagggggccatgaaaaatacagaagaaaaagctcttcaatcagagggaataaagagaaagaggtttggcctgtaagaagcagttctttgaatttcattttattttttgagccaagctattagatttgtgggtacaaataagatctctttgaagttagcaagaagcccactgtgaaagaagggagacggccattaccacacattttatatgttgagcaaataaagtcccaggattcaaaatatattctgcaattacagaaagcaaaacacttttctttctcctttcaccttgtttagaaagagcatttttctctagaaagagttctgttgaggctgggtgcagtggctcacacctgtaatcctagcattttgggaggctgaggcaggcggatcacctgaggtcaggagttcaagagcagcctgaccaacacggcaaaaacctgtctctactaaaacacaaaattagccgggcgtggtggcgggtgcctgtaatcccagctacttgggaggctgaggcaggagaattgcttgaacctaagaggcagagactgaagtgagccgagatcgtgccactgcactccagcctgggtgacggagcaagactctgtctccaaaaaaaaaaaaaaaaagagagttaaattttctctttccagtttcctaactcccctcctccgattttctacattgagaataacaggctaataatactttctggaatgcctgttgtagtgttaaattagatgggatacacacatatattcttagtgaatcacaaaatgtgattcaaatagaaacttcagtcatttctcttctattattgacatgttttctcagcattttgtcacgtgcatttgagaaatgaagtatcaataaggaagagaagcgtatgttaagactttcttagcagctggtgaaagaagcattccgtgtgtgtgtgtgtgtgtgtgtgtgtgtgtgtgtggtgtgtgtgtgtgtgtgtgtgtgtgtgtgtgtgtgtgtgttgggatgggggatagaattcactgttggagacacagggtttctaagccaggctcaaactcctgttggtcagggacttaggatccaggaaaccttaccaaggaaagaaaactaataagctctataataagctcctatatatctggttccctgactccaaatcaattgaaaactgttgggacttaagtaacttacaaatgcctttttaatatcaagaccaatattatatttttctcactttttacattttaatcatgcatgcttccttaggtgctgcattttttgagctgttattaaaaatacataggttcctaccacattaaaggggagcagaggcttgtgtgttgtattgttaattatgtgctgaaaatgaaattctggtcagtctttgcagaaggtacaaacacacccctaagcaaaggattttccatgtgaagggagaccgtgtggtgcaaggctcgttgctctgacttaacatgcacttactcttgaggtctaagttcctggctccggcggtgatttgcgttgtgatttttgtgtcaatctttacagtgtggaggttgctggtgtcccttgatatcatcacgttgtgccactgattgtcattgagaggtttatttgagcttcctttgatgaggttagcaccatttcccaaatcaaacacgtaatgtaagtacctgggaaaaaaatgaaagaggggaaagtgccatcactttttaaattttgatgaacctaaagtagatattacaaatggagattttttttcaggtggttccatccttactagaagtcatgacaataagttacatagaaactcagctatcaagaaggtaacaaacactattctgtttcagcaaagaggattattcagtgttttaactaaaggaaacagtgaaaattatttttaaaatcatggtctacatttaactttatgaatttggaaagcaatatctttcaccacgcgctccctgtttccacaattccctccatccttttctaacacttaaaatggccattcttctcgttcttgcacttgcttttctcctctatctcgattccctgtttgaggatagggaacgtgtactcatccttcaacatccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcagaatgagtgaataaatgctgaaatcaattaaaatacattaaattttcctcacagttttaaggcacgtttacacaaatcttcctttctaaattctctaaggcactctgacatagaatgaagtttgagttaaaagggtttttttgaaatttaaacaatctgagtacttgaattagctatttaatttagcatagactatcctacaaacctgtatcaatgcttttgtggaattacattgtgcatagtcaggaaatgcccatttgaattgtaacattcatgaaatgcctaccataaattagagcccaatgtaatttgtatctcatatgtgaaaatgtaggtgcaaaaaactgtcctaaatccatattaatttaagatacctaagagatgatttaaacaaatgccttcttatttgtcctccacctgctccggcccaccaccttatgagccagtatgttcttcttagtgtatatttttggaaattgacgtccatttttccaaagttttatttatttgctattgaacaggcatgtactcaccctttaactaattcaaccacaataaagtcatttccatccccactgttatatagaattaatccatctagggatgttgtcttgaactggaaaaaaagatgcatagaagtgtaggcttgcaaggtagctaaggcaacatagctcgatttggtcttgaaggtgacaggatctgctatgatgttcctgaagccaaatctggcattaagctcacagtaatctatgtcgccatttttacacaggtcaatgtatgccattccattaaatgtcaagctctgcaggtgtccaatgaagttggaggggacagaagaaagataccgtcgttctgtgatgatgccagtctctatgttatggaactccagcctagtatgatcacctgccatttgacctaaaagagaagataatatatgattattttctgtatctgaaaggcactttcaactttaggctttcataacaatatcacattctaaaatacaaggagccaaatccctccttggtactcagttgcatataggaagaacacttaaatgatgccaaaaggtaagcctagattatataataaaacattcttaggccaggttataatccctgtccaaattttagtcttaacaaaaaatatcctcattaacaaaagtaatggtatcttttaaaggcgaaaaataaacaaattagcaagagagtgagcacatagtaaaagaaggagagggaggaaaaaaggaaagaagggagagtgcacagagagacgcattaggagcagtgactattctcagtcacccaactagaaagtgatacatctcagcctcatggataggtgatgttattccttataaatgttcttccaggaaaaaaaaatgtgactatatattttcctatacccagtagaaagagtggagagttgcagccctttcttccagtaatgaaacatgaaagtgtgtttgaagttaaatatacactattcactttccctcttcgtgctcaataatgaccatagtttttgttcatgctagtcttctaaatacattagaaatcctgttgatttcttcacctatgcctttttttgtccttaagttttctataactaaatcaagcaaaatacactaattgaaagcttgcccaattttgataataccagtaaaattggcccaccatgccccataccacaaggcaaaaatcttctttaaacatcctagggtgaagcttggatgcaaatttatttagcaactgactattccactcagtcctcatttctctctatccctgcatatttccctgtcaaacccattaatagcaaacttagtcccatctttatctccagagtgatcattttacctgtttgcaaggttgaaggtaagataaataagcaaagatgtgaacttgttttctaaatattaaaacacaacataaatataaggtacttgtatcagtaccagtgattcacacccaacatcttgctcttgtctaaataaactgtcagtcactctcttctgcaactaaaaatgctcatttattttgtaatcaagttcttccacgtgctagcttccctgcccgatttgccataattggaaaatgtttcaagttacctctttccatcatccacattattaatgaaaatattaattagagctaatcccagaatcagcccctgagaaaatgcattgaaccttttccccaggggtaatgaagactgaacaaccacctatgtgtgtcccctttggccagtttgacaaatttccatttctttagtcaagacagtaaaatattagacagtgtttaaggaaatatctgtaagtaaaatttagacgtcatgctttttgttgtgcaacaaaaactgtttatatgtttgcttaagtgactttgatgattatacatatatttgtacacaaaactcccctgaactgtacttaaccctatttcattttcaaacactcttttttagtcttgatcctggaaacaacattctactcatccttggcatgttctcttttcagccattggtttgttctgattcccttcctgcaaacatttttaaaacaaaaatgtcaccataaataattgtttcgtctctctctaccctcactaccatgcctcctgattgtctatctgatgcaaaagtactattacatccttgtcaattctggtttctcctgtgacatcatttctatcttctcccccagttcttcttgttcaatgacctcaatattgttctgtggggatctacttctttggtaaaaaataaaattaatccttaattatttccaaatataaagctctaaagacaccagcaacattgaattaagaagctaagtacaatgaagaatatgagaagcttaaaaatcgtctagatgcggtggctcacgcctgtaatcccagcattttgggaggcctaggggggcagatcacctgaggtcaggagtttgagaccagcctggccaacatggtgaaactctgtctctactaaaaatacaaaaattaactgggcgtggtggtgggcgcctgtaatcccagctactcgggaggctgaggcaggagaatcgcttgaacctgggaggcggaggttgcagtgagctgagattgcaccattgccctccagcctgggcaacagagcaagactccatctcaaaaaaaaaaaaaaaaaaagtcatatgggctttgatatccctttgggttgatttttattctatgccacattaaaatatgagccttaactcagtgacccctaccctgatcctgaaactgtcatgtttcatcttaaagtctctattgatgaaacaaccaatagtaaaaaaattctgaaaaaaatatttctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactactgtagatatttgttgattaaataagaaaaaattataagacttcgaaggggaaagatttttaatgttctaatgatttaaaaatgcaccatccaaggaaaatttggaataagcaaaatgcctctgatcacaatatttaaggtataacagattgacaataatctccaacaagacaacaaccaaaacatgtttcctagatgctgtgtttgtatagaaatctcaatatttccaagtcaaatatttttaccaaaatagatagcaaggttaatatgtgctctgcgttaggttacatttctcatgtcgagcaaaataaccctcccttacatccacttgttaattcacttaaaattgctgattgtgtggtatatgtgtccggtgctagccttggtattggagaaatagtgttgagaggggcagaaagggcccattttctccaaactcatggtctacgggagaaaggcagacaaaagaggttaaggttgtaattaaatctataataacaaaactcagagaaatgttatgaatttgatgaacgaggtattgtgttggtaaatgtgaaatggaagaagatgccaggtttgatatttaagctagatttgaagaattaaaaagagaaagccctgttaagaattggagaaagggaatcaagggtggattccaggaaggggagacggatgaaggaaggcttttggataacaaacagctacagagcatggctggagagctgggaacaagtaggttagtgacccacatgggattgaaaggagcgggagcgccagggtccagatttctcatagtgcttcttacattcagagctaaggaggatttgaagcaggggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgatgagcagaatgaaggaagggaatgatgatgcctggctttcaggcttgggtaactggatatatggtgaatgttgttccataaaggacatacacacacagattaaaaaaaaaaaacacaattctagatttttacacagactggatgatgaattgaagcccagtgacttcccacttagggattccacaaaatttgtacaaccccttgtcatctatgacctaggaaatctccttccttgggcttctctgctggcaaatactatcctcacgatcctaggtgaggtgcaaacattcccaagaacagcttgagtatgtactgccctgtgttcaacagataactgacttaatagaattacgataaaacttaaagatatgggaaaatgtaggactttgcatgaagagtctctagtaccttccttgcagaaattcttctcattcagtgatttctgacttgctgtaaaatttaataagaaactcccattgcttctctgatttatgggtggcttcaagtggccactaggatatttgaaggaaatctcaatctaaagctttcattgccacatttggaagccttttatgtactacgtaaatcaagactgaattattcttatgaattgttggctttcatgagatctctgacaaaatagaagaagaaggaaggaagaaaggaagaaagaaaggaaagaaggaaggaaggaaggaaggaaggagggaaaaaataaacaatttacccaaggtatttaaaaaataactcagcatttgatgttaagtcttaggaaggaagaaatgagacaaacagtcgtaaagtaatcctgacttatttgttgccttcaactaagaaggcagaactactataactgccctagttcactctacaatctcttgcacccacaaagggaataaatacacacacacacgcatacccacacacactcagacacacaaacacacacacacacgagtcatggttaacccctgcttcaaatcctccttagctctgaatataagaagtggtacgggaaaagcaattttgaaactattttagatgcattattggattaagcaaatcaataaatgacattactgggagccaggattctcatcttggatgaaaacatatgaaagtatggaatgggaaaaataacgaaacaatgttgtaggtatgaaggtagcagtgtaaactcacactttataaaatgtgcattatgtgtatgtttatatgtacatataatgtatatgtctgtgtgtagatacatttacatgtatgtttgggtgtaggtatatatacttgaatacatttcttatctctgtctgctgaaggggtcaagtagcaatgataccccagcagcactgaggtcacctaccacccaaatcttggtctgtatcattcctcactaaatggaaattaaatggctaattctaggggcgaagtgtggtagacaaaagttgtacctggaacatcctgttattccgagaagtaagaaaagggccaggcacggtggctcatgtctgtaatcccggtactttgggaggccaatatgggtggatcacctgaggtcaagaattcaagacaagcctggccaacatggtgaaacctcatctctactaaaactacaaaaattagctgggcatgatagcatgtgcctgtaatcccagctacttgggaagctgagacaggagaatcacttgaatgtaggaggcggaggctgcagtgagctgagatcactccactgcactctaacctgggtgacagaatgagactccatctcaaaaaaacaaaaaaaaaaagaaagaaagaaaaaaataagaaagcgctaaaaaaataattggaatgaaggcatgtcatgagatcatagaggccaagttaatgaaactcacactggcaaaaattgaaaaacatttgcgcaccaaaatcataagatagcgtaattatgaagtattataaaaacatagcaatagtgggtctacaacaataagaaaaaaaggaagggaggaagaaagaaaaaaagagaaatgaaaagaaagaaaaattaaaaaaaaaataggaaagaagggagagagaaggaagagcccttgcttacagcagaatgctaagcattgactgtaaatgtggaaggagtgctggagtttgaaaataatcattttttgtaactctcagagtaaagattgaatcaagcaaaactctgcaatagatactaaatctagggcaaaattttgatgagttacaggatatttacatggtcttaatgtctccccacagacagtttattagttgaaagggagaaaacgtagtaattatacaatggagaaactggacaacatgttgaccaagtggtcaaattaaatcaccaaagacatgggcagcgtatgccccagatgggatactgtatagaggccataacatcaacaacgcggtatttcacccaagaatgtaaaatatacattcagtcatgaggaaatatcagataagcacaaactggtgactttatattaatacaaagcaggaagagattatatacttcaacaatgttaatgtgatgaaaaacaaataaagtttatggaaatgttctagattaaaggaggctaaagaaacatgacaactaaaaaaaaaaaaaaaaaaaaatagctggccctagactgcgcactgtgctggaggggaaaaatgcttattgcgtattgataacattgaatcaactgacaaagctggaatatggattacagattagaaaaataaattgttatctatgcaaactttactgaagtcagtggcttttatttcttaggcaaggggatattcccatttttaaaaaatacatgctgaagtatttcgggttaaagggacactgtgtatgtaacttaccctcaactggctaagagaaaagttagagagagaagagacagtgagagagcacaaatgtcaagacaaactggcttaaatgttcacagtagtaaaggtataagggtattctttgtattatttttggaactttttataaatttgaaattattttgaaataactttctaaaatacatttcttaaaaaaaatgtttttcaccattcttttgttttcatcctgctacatccaccgcagtacaggacttattactttacaccctagaccatccaaaacactgccacagaattaatttcgctcaaaacatattttctccacttactcttcagtttaagtgcagtgacttccaatttcctgaaagtctacgaaatataaactacttcatctagaccatcaagtcattggcctcaaaaggccattctagcaccatgcacttgcaagaagcaaaataaagcttcttagttccctgaaaattattctagccccaccagcatcattctttcttgtctggaattctttcttgcattatcctttctttaaagcctagatcaaacattatcaattgctttaaacaatacccaaaaccaagttccttaacttctcttctgaactccaagactataaagtactcaagtcaaccattcagtagttcatctgttactctatgtaacatatcaccctctataataatctgtgttttatatgtatgtatgtatttgccttataatatcatgcattgtctgataaaatactttctatagagccatacacttactagatattgacaaatataaagcaagggacggtaagtcaaaaaccaacaaaccaaaacacacaaaacaaaaaaataaacgtaggttctctcctcagatctcgtaacacattccaataaaacataattcacttatcctcttcgagtgccacttacctcatctacaaaatgggaatatgtgtgtcctatctacttcataggactctaatattcaagaggcactcagagattttaaaatgttctgttgtagttctggcatgatcttgccgttggcagctgcctcttcccaaactcttacatgtgaccttagatactaactgttcatttccatgccttttgataaaacccagttgtccaaactgtggatgctgatctaagaaacaattcattcctcttcaaagaactgtcctagaccaaaactaattgaactccaatgatactcttctgccctgtaaattttttttaccttcctttcctaagttaaggaacgattgtttcaaaagtttaaaatcctgtaggtaatatatccacattgacacagttgactgttctctgggcatggggacctccttcgaattgaatgaacagacacgtatccactgtacaaggaccattttgtgctttttaccagaataattaacatggctatctctctgaaaaaagaaaaagcagctaatatcccagtgggtcacgtgcttggagttgttttcaaagtaaataaaggcaaaaggatttttcttccatgaggctttcctatgtttctagggtggacctgcatacagctcacctcaggaatctaaaaatgggggttgaacttgacatccttaatattagaatttaaccaactgagctgagtggccaaaaataatctattatagcttaaaatgaaaaagtgtttcatctgaaagccagatagataaacgccagtatatctatcatcttacctagaagttaaaaggtaaaacttgcagttgttcattgccaaaatatatacaaaacaaagaaactcaacagaaattggcatctaaacatgactgcaatatttgatgaggcaccaagatatttatcaggccacaaaagaaaatatattataatttcttcttgcactattaaagggccaagaatatgacataaaatgtgtcatttttgaggaaaaacacctaacagactgcttatttaataaaatagttactagaaaaaaatagaataaaaatggattgtgtgaatacatttcaagttgtgtaccagccttggtgtgcaaaaccacctgcaagaaatgagagtcaaaagcgttagcataggaaaagacaatgggacagaggtgtttacctgtcatggcctgttggtcatccactgttaactttaaactttttccacgccgaactacacgcactgtgtgccactcgttatcattgaggttatagccagcaaaaagagtctcgggacctttgcctgtagaatatgccaaacagtcattatggacactcagaatcagtcaagcaaatgaacctcacagagagtgagagaaagagacaaggggggaaggtgagggagagagaggagagaaagaagaaaggaagaaagagagagaggagggagagaaaggaaacagagaagaggcgggctggaccaattttcaagcccattagagtcatagcaagcaaggaaaatgacaacttttacaaacattcaggtgtgaccatttaagaatctttaatcctacgcattgatccataacaagtgaattaacctgctgtcataaataggcacagtcaatacagcactgggaacccacccaaatttacacacacatttttaaaaataaattctctgatttttagttaccactttcctgctaacaaagtgtctagccatcatgtaacctctgagctctagaagacatctgactgtagcccattagctaatcgttttcagtgagataagtctcccagtagactctgggagaaggtactatcttgtgtgatggcggctattccgctcttatacctggtacctccagtgctcaacacgttcttaggttctttagcctcctaaatttatggaatgttgagtctaaaaaacacatcgaaataaaccttacaactaattgacctgtacgtcacaaatctgtctgtgtgtggcagaggcacttctggcaggtgtaggtataagtattgactcacagtaagtggaccgaagaaaaggaaagaaaaaaaaaaaataggcacagccaataaagggccaactgttgagcatgaaggaaaagtagtgatattaaacaacagtagagagcaagggattaccagtgggcatcgagtgggcaagaagtataactgggaaagtaactgctagtgaatctatataaacctatgcaaatgaaatttaaatggactcagcagagacatattatttcagaaaggtgtttggtagaaattattgaaatgattaagttagactatatccgtcacctcaaaaaaaaaaaaaaaaaaaagcaagggaaaatgcttttaacataaccagatatttttatttaaaaaataagtatttctactaatctgacattatgagtcattgagaaaaaataacattaaagatacattgtttggtaatgaattttttccctggtgtttttttaagtatggaaacatgctggtacattaaaataatgaagggcattatatcattgagtttcatgtctttcaacgaattgagaatcaggattggagttcacaatttgtttaaccaaattctgccagcaaaaccaattaatgcccaaggatcacgggaggatatatgagaaagtaaagatacaggccaaggagaagaagaaaaaaaaagaggagagcaagagagatcgagtaagagacagagaaccaagtaaaataaacctcagttttccatccacatgagatcattgttttctttcagaactacaccctatccaccagcctattgatttctctcttatggtgctactaataattcaagtgttgtatccttggctggtgtatctcaggttagaaatgagccagtgatatgagctaaattttaaaggatgaattgcctcagttatttatatctgtttgtatctttagagaaattaaattacaactccagatacatgaatttaaaactattctagatataacagttttaagagattgatggctaaataactagagaaagcctgctagtccagcaactgcaaaaatactttgagatcaaatgttgaaagcaagttccaggatgaaaaaaaaaaaactctttctaaattcaatagtgaagaaagaagtgtttaataactctgcagcatcttagcatcctgctggcagtaagggtcatctttcattttgatccttgaaaagagaacatatcattttagagctatttttatagggaactttttttttttgttagaaatatgtgcttttgaagcagcttcacttctattcttttcttttttaaatatattttgtcaaggaaaggaagcatacataagggtgatatcatcgttataccccatccttggcttgatcttgcagtaaagtcataatgcttaatctatgcaacaactatttccataacaacaggcataaaatccaattaaaaataaccctttggttcataaaaatctctgtgcgccaacttctagctcctttcatgcattattaaaattgtgaacagattgattttagaagataaggtttttaaaaaggcacttaatagtctcacttcaacacaatgttacccatgcaacatgaagtgtaatggaaagtgcactagactgggagttaagaattgcagttgctagatcatgatttcctactaaaaaagaagttgggggttgctgagtgcttattatgtagcaggcactttgtctgttgtcttgcttcacctttacattattaatctgcagatgtgaaactgaaggcctataaagctacaactacttgtcgccaggtcacacagctaaaaagtggtagaaccaagtttcatccttggcctgacctactcaaagcctgcatgcttttccctgcattattcagcctcgtagttatgagaatctttggctaacaacttaatttctcactttccccatattggaacaaaggagatggaaaagatcctctttgtggtgactcccagcttgccctacagaatgatcacactgctagcaaatcctacacaccctctgcacaagtcctggtggaagcaaatctctaagtaatacaatgtctatctagggatgctgaaatgactgttcctaaagatatgacacagaagaagggacatcattttaggacctgtctccacccacaatcagcaatttgctaacacactcaacttctggtggtctcagcattcccatccataaagtgaggagagtttccagctgatctttacagttcctttagaatttcactttctcacagaatttaacatatacaaacttgttaaagaaagatggtttaactgttgaaattttgaatttgagagtttgtcctcttgctataattttaatggcaaaattatagtaacttcaagctgttaatgacctttcaggatttcctttcctttgggggatatcaaaccatgcatcagttgtgccaacgtctttctccctgcatcaatgtattacagacttaatgtgtgtgtccctcagaattcactatgttgaatttctaacccacaaagtgatggtatgagaaggtggggccttcaagatatgattaggtttagataagggtggagtcccatgatgggatagggccctcacaagaagtggaacaaacaccagagcgtcccctctgccatgtgaggatacaaagagaaggtggctgcctaccagccaggaagaaggccctcaccaagagccaaatctgctgacacttcaatctttgacttcaagccttcaaaaaactgaggtgaaaaaaaaattctgttgtttaagccatccaatctatggtattctgttgtaacagcccaagaagactaacacagtgggcaatattttaaagacttttaagaaagtctatagctggctgggcatggtggctctcgtctgtaatcccagcattttgtgaagttgaggcgggagaatcacgaggtcaggagtttgagaccagcctggccaacagggtgaaaccctctctctactaaaaatacaaaaaatagctgggtgtagtggcaggaacccgtaatcccagctactcaggaggctgaggcaggagaattgcttgaacccaggaggcggaggttgcagtgagccgagatctcgccattgcactccagcctggatgacagagagagactccatctcaaaaaaaaaaaaaaaaaaaaaaaaaaaaccacaaaagaaaagaaagaaagaaaagaaagaccatagccttatgtctattaaaagacatcattccttatgttttgtagggagttttgatttgtttgtaattttacacttgatttttactgtaacatattatttaagccagatatattaatttttcattttatagttaaagaagcagatttaaaagtgttgagcgaattattaagtctcaaaggcagtaagaagtagagagaagactgagattttgaaattttctattttcattaaaatgtgttttccacagaaaatgatctgcaagtagtgtaagaggtacaacgggactgaatgcccccagctaatatttcaccagaccaggtcagaattcagctctacaggctaatgttatattaaagaattttagaactaggagggacatgagaagtgtagaatttcaatcatcatctacaaataagaaacatgaagtgcaaagacattagatgacgtccccattgtcacaactgttaaattaagaagcataggtctctagactctcagtctaacaagcttttttttttttaattattattaagacagaatctcgctctgttgctcaggctagagtgcagtggtgcaatctcggctcactgcaacctctgcctcccaggttcaagtgactctcctgcctcagcctcccagggagctgggattacaggcacccactaccatgcccagctaatttttgtattttaatagacatggagtttcaccatgttcgaggccagtctggtctcgaactcctgatctctgccagccttggcctaccaaagtgctggaattacaggtgcggaccacagtgcgcccagccctaacaaacttttaaaaaattattctgttcattagacaatgctgatttagaatgaatttctcaaggcacaccaaaatctgagtctgagtttaataagtctgtcagtgcttgtcaacagagtttgacctaatctatggtacaacagccaaattttttggctggtgatattcactgggtttgctggtgaccctgtagctaaaacctattgataacagatggaagtagaagcagtaaacatttcagttttccttaattcagtgtaaattgagtgttcttccacaacctacccatccataaattcaaggtgtctctaagattaactcctaagaagggctggagttaaccctaacttgaggcatggtaccgacagaggaaaatgtgtgttagcaagtatatgtgtgtatgtgggtgtgtgtgtgtgagagggatagagagagagacacacactcaaaagatggtagatttttggccattttagtaaccacatttgctaatgacttttacttccattttcacatcaacatgattcttaggtttctttaaatattagtctcagaacaaaggaaatttcatgctataatttgtagttatgggaggtaatggtaaagaaaattggattttgtccccagtctgtcatcaactaattatgttaccttgaagacgacatgtattctctctattcctatttttatctgtaaaatgataatcccatataaaagcatattaaaaaaaaaactttcctacagccaacttcaaactattgtcattcttagaaggaccaaaactacctcgcggctacatgaaagagtgcaatgttatagtgaatatctctaatggtgcaagctttttatttttattattactgttactaatttcatcacttttgttttggcacagtaggcagagagcagaccaagccttaaagaggctcttctacccaagaattactacactcaagtgaagccagaggacaatattaatacgtgctagaaaatgtgtttattattttatatagtcaaattttaatggtgataacttttttcttttgacaacatgtaattatgttacaactatttttgttaatcactataaattttgttaatcactataaattatatttgaaagtactgaagcacagactactaagtgaatgtatttaagaaagaaagaatagcattcaagggatgcatagctatgctacttagtccagctctccttttacagacatctccatgggaggttagttgccttgcctctgtcttccttgttattggcaggatgaaactaatgcctgggtcttgaacttatttaggacctaacatgcattacctaattgtctggccaaagtcagagagggtaaacattctttgacctttgcatatcattcctttccctatttatatttttacatattcaaaaaatattgttctaaatacattttaaacaaacccacctgctttggatagcagaatcagtacaatttacaaagaacctcactgccatacacagtttcggaagcagtgatgaaacgggtgtgttttttcacatacctctttacatttggttcaaatgtagattctcatatatttcaggggagatctgcatgcatcataagaaaagcttgaacttggttgagagttatataaacttggatttgaaagcaggtattgcattttctggttgcttaggcttgggtatgttagcttctttgagctttccttccatcatctataaatgtgagataataatgcctaccttatttcatagatttgttgtaaggactaagggatataacaaatctaatgtgtttggtgctttgcactttgtgtaatctcaatgaatattaatttcctttctctcctttttatggaaaataagttaagtaacagtgcatgagttctgcaaaccaccaaaggatctaccattaaaaaatggttgacagtcaaatacactatacactatataaaaatgtatattgaaagaaacatccacaatttttatttgaacacgcacactgcagtctagttttttgaaattaggcctcccaaagtcaaattttttggaacagttgccattttaacctgagatttcacagtatttgtgtttggttatttaattcctaagcattcaccctgaatataaaaataaatgtaaaatacacttgcaagggaacctgaaatagatcaataacgacatgcttaatcttgctgggttaaaataagatgtacatgatactaaatttggatgctttttgctacaaagccttctgtgcaaatatcttgtgaacaatttatactggtttatgaatgtggagggaaaatatagtgaagagaaatagagaagaataaaacaaagctgagaccctttcaagcaatggaagcaaagacctctaagagacaaaactggcagatgcctctggaactgaaaggtggatgtagctgtacagaaacttgaaaaaaaacaaaaacaaaaacccatagcagttatatttggagttttaaactcttagatgtatgtgccccaagtgtaaactcattgcatctctacacaccctttaggtagctttctccctctagtggtgcatatattttaaagaggttaactacataaatgaactatctttatggtgtaccctgcttctggtatatatatactctggtacagtgcaaaccaattggttctaaagttcactttatttgtctaacatattcattgtaatttctactttaaaattctacctagttatttcagtggttaatctgacttactcaattaaaccatttatcgagcatgaagattttgatgggtatttctgcaaaaccatcacctaacaaattgcacagatgatggacaggcaggaattttttaaaaatactagaatcaccttatatgtataaattggttctatatttatacatgattgttcaatatatttagacctacagcacctggtaattgaattaggaagagaagttacagtaccatagcatctgagaattataaaattttaaaactgaatggtccatattgtgtctgttgtttatcccatttagctactcatttattctgggttccatggcacccatatgctattaattttgtttaaaatttattttgtgccaaataccgatctcagcattgggaatatccgagttacagtcaaaggaacttacattctaataggtcagaagtcaaaacactttttctgtaaagggccagacagtaaatttatttgactttgccgaccatgtgttcaccattgcaactcttcaactttactattgcaatgtaaaagcaagcatagaatgtatgtaaacaaatggagtggctgtgtttcagtaaagcttcattaaaacagggagctagcttgagagctatagtgttcaagaccctgtaagataaacacgtatagataatttaaacgtttcccataaattctgcattgcatattaaagaataacagaaacatactcaagaatttaagtgcgaggaaacctgagttttagattcgatattgccactaactgtaacataaccttaaaaatactaattctcctaacttttttactgctgtttgttttcttaagaaacaactaaaatcaatttttaaaggctttaagcccgggctccccaccccccaggccacagacaggtaccagcctgttaggaagcatgccgcacagcaggaggtgggcagcaggcaagccagagaagcttcatctgtatttacagccgctctccattactcacatcaccatctgagctccacctcatgtcagatcagcagtgacaaccgattctcacaggaatgcaaaccctattgtgaactgcacatgcaagggatctaggtttcatgctccttaggagaatctaatgcctgataatcagtcactgtctcccattaccctcagatgagactctctagttgctggtaaacaacctctagttttactgattctaccttatggtgagatgtataatgatttcattatatattacaatgtaatagtaatagaaataaggtggatgatacatgtagtgaaattcaattatcctgaaatcactcccgtctgtggtaaaattgtcttccatgaaaccagtccctcatgccaaaaagtttggagaccactgctttaaatgacacaaatcaattgcaaagtccttctacttataaaatctaggataaattaggttcctttccttttctgcaaatttagaatagaaacattcattaaatgcttggggtgtgtgtgtgtgtgtgtgtgtgtgtgtgtgtgtgtgtgtgtctgcatgcacctttgttaaaaatttggttattaggtttctacgtatatcaacttttccaggtactaacaagttttatttggcagttgactttggggactgtagtctctggggtgaggcaggaccttgtgagaagctggaagcaagccttgtcattgtgacaatgatgagaagatggaagcaggagctaccactgcttgatgcctgagtcatagttgctggcagcagtacttcctacctacaaatgatgagaggatatgtttcccaggttgtaattatgacaccttcagcctactatttgactttcccattactttctggttttaaagtaatctgtcctccagttaaaaaaattcaaaggagattaactcctcattacaggtttctattttatccttctcaatttttaggtattgagttgtgagtgaaacctgtttgttttaatttttcacaagaatcagctagaacattcaattacaaattaaatttagacatgtaaatggcacttctaaattttcctttttctgcctcttaacattactagaggcaggatgagccacataatttgagagtccattgcaaataaaaatgtggagtccttattcaaaattaagaatttcaagatggtagcagtggagcattaacccaagcacaacacaagctcagcatatggcacggtgtgactgcataagttgtatgctgttgaagccagttctttttaggagtataagttttgtgcttatttatttttgatgcttcctttagtagattctacattcaggaatgagcagacaaggctggaggcaaaattcttcatttatctatgtgagaagcatagttgagtcaccttccccagagtatccacacttaatgacatggtctctggggtatcagagaagctgtctcaggcttgttttgctggccaggcctggtgccaatcatgaactgggcttggtgatacaccaataaccctcagaaccaggaagcaaaactacctgctgacccatgtaactcctttctcttttccttctctattcctcctcaagtgctcctcaatttagccaaggatatacccttgagaactattcagaatgtcccataaagagatgcttgcctccttttttttaataagcaaagagatagagtcctaaggacagacacatttctttatgctaaaaatactagaaatactcatcccagttaaaaagtactttgactaaatgatataaagtcagacattcagcttgatgtttgtttttcaaaaatgaacactaataacagagaaagacattttataaactttaaaaaatccactggagaaattaaatagtcatgtgctgaccaactatattgcatttattttttgacccacacagactgttgagttttatcctggttctacaagttattagctgtgtgaccttgagcaaccttcttactttctgcatgcctcagtatcctcatatatctcataagctaatactagaaacaatgtaaatgggtttcatgcatcttaataactcaaaactacttttaatcaaaggtttaatgcatcttaataacgcaagaagcttaccataatctgatttatggtaagctttcaattatagtagtgataaaagtaactatcatcagtattatgttgtcatttttatcttctcctcaatgagtttaaaatctcagagaaaatatgatatagctcagtgccttgaacataacggcaattcactaagtatttgttgaatgggtttatttgtgtaaactttgtgggacttttttttaaatggtagatgaaataccccttgatattaaattaagccaagtagttgatgaaaagtaactccatcttttaatgcctccattcactaagaaaggtaaatataaagaaaactctgtcctcctgttttcatatttagcaggatggaatttggtaacccctacagttggagaacttgagtaactcagttatctggataactatttggacagctttttcgctcagttacattgaaaataaacttcatgatgcatacagcctagtggaacaaaatgacctaaggttagcagtgaataacttccgagtccaaaggaaatagttggcttagaaattgggggaactcaaaacttactgagtatttaattataaaaaaacacagatcttgtcctcaagtggatgtgaccttggagagttgttggaaacaccctccagagacttttctgccattttcctaaatgatagcaaacttattctattatctacaaaataaatttcagtatttctcgatgcttcacctcctgctctatttcttctggcctataaatatcattgcctatgcaaacgaataaacaaggttaaaatcacctacttcatctactaagaaacattaagcctctgtagttttgtcattgattgtacccatttatgacagacaaggataaatatctcttatgtaaatatatttcaatgcgaaaaacatacattttaagaattataatttactttttaagaagagaattacatttacaacacagtaaaaatgaacacaaattaaataaatatatttctagaaaaaatgttctaaaactagcaatctttaaatctaatctagctcaactggcaagtttaagaagtataataaaataagcctaatacaatgaaagtaacaattcagactgtgattttatttttttcaaaaggtcaattccaagggatgcttatcacataacaggacagctagcagatataaaattgagtactaaatagttcaatttgcttttgagtaagcattaaaaactgaaaatgtattcagtgtttgtgtagtgttaaagaaaagggttatactgatttatagtaatactcatttaatgtattttctgcaatacatacacaatgccaagttgtctgaataaaaaaaaatcaaaaagcatatgggtcctgagcatttggatatttacaaaatgtaaactgatattccataaacgaagccatggattatagtcacaaatgcatttttttaaaattaaatatatcattccatgtctaaatacaccactgtaatagttatagcatttttttaatgaggtcaagaaggatgtacattttttcataattcaagatcaatgaatttaccttttactttccatttcttcttaacataaggatagctgaatattattaagtacatgactgaattcacaaaatttagttcatcctcagtatttttgagatattctagtataaactttttccaaaagtaagaagcatattagagaaaaaaaccctaagtttctgcctttattaagtttatttattttttcttcctttctttttactgggaagtcattataatgcgtagaaatctatttctcagtattgtcaactttatggacctatttgcttaaagaaaacaaattctaagaaatgtgacaattgatgaatggtagcatctcgtgtcttgctttctttttgtttctttacataatgattgttcaaatgaaggctatggacaaactgtacatgattattaatgcattcatcatgtgaacattcgaatgcaatatattttttctaagcaatgatataattattagctaaacccttctttatttgaattttaagattttaatgacagtgctaacttaattgttttctttaatcatcactggattatttattaagctagcttttagtcagtggcttgaattctatgattctctttgaccatttattttagtaattgaaaaatattggaattaattctttgaagttatctttgggcaaatgtcttctgaaatgaatggctcaccttatgctccaggaaatgttctaaaatggcaattgtccaactataacaataacttagcaattaaatcttaggccaaattaacttggtttatctgaagagacagtgtgtgaaggttccttggaactggtcaaaccactgatagaaatgttgagttatgtctctgtgcctgtttctggttgatcttcctaaggtaagattatgttagattttctattagtaggttacagtcaaggacgataacttatactaacacatctagaagcatcttctcatgtgtggctattcaaatctggtttatttctcatgatcttgttcacagatgctcccaaccagttatcatctgagaaaactgagatcactgaagaatcatggtataatttccattggtagacatatttttcctccctattatatgttacttcaactggctcagtgacctggaattgctttatataaccttggcataaaatctaagagaaacaatagattacatttaaaaatattgtatgttttaatcaaagacaggacataatgtttacaagatgttgctaaaattagagaacggggtgcaaaacattcctataccatggctctatatttttaaagaagcacatattataccatgtgttatatattaagtacataatgtgccaagtattatgtgctataagggcatttaagacattaataaaacttttctgtgaaaattgaaatcctaggctacttttatgtattttctgtttcctttagcctccaaatatgaatactatttctgattaggaacaaaatgttgttctgaaagatattcattctattttgagagtcaaaattagtaggaaatttagcctgtaaattaatttaaaatgtacatgatgtattacaaatatatgatctagtgtagctttatcctaaatattggtgggattggtttaaattatattttacttttacccacttttgattttttaatcacaatagcaaagaaaaaacattgtagaaattatagatgatgaatagaaaaaaaaactaaaaattacctcaatctcaccagcagatataaacatttagagggatatacttccagaaacataatagaaaagcaattttgttatgaaggtcccttgcctgttccataattgataactcaaaaaaaataggagatgctgattacttcttcactgcctattggctgaactaattttacttaattgattgcataaagaatttcttgattaccaatatattatttttagcagtataaaatttctcagttgatttattaaacagaatttattttatggggtttctacaatttttatttattgtactcatcataatggtctaactccatatttatctgcctatttcaacactattaggtgaatatgtctgactactaagagaacacctgcattatttgatttaaaaatttcttttttattttctttactagaaacttataattcatgaaaaatctgtaaaaacaactttaagacatgtcattacagtatgtttgttctataatattttggttttaatttttacatgcataaactacttcctttgcgcctactgaaatgtaaaacattttagaattctttaagttgtatagaagttcatacttatttacactggaaacttcctggttccaaagctggttgatttctccatgtatttgaaaatttaatgggtgcacttcactagaaacctacattcttcgtaagcaacatttaaaagggattttgttaactcatatcttaaatcacgcatttcaaaagcaattttaaccataacatttatctgtagaaaaaggcaattgtctttgaaatttaattaatttcaatagtactatgcataaaatatttcgagtctgtatttagactgatatcctgggaagtgcagttggagagtgaagaatttccacaattgtatgaatgatgaactcaaagaacaagtaataataaacaatccaattttaagtacattaaaaataaagtaatttagccttttagtatttcttattcatcttcaggaaaactgttttcataatgcatttcttatccatcttgctttttgctcacattgttaataagtaaaagaagtggataagagttctgagcacacaaaacatttcaatctccaaattctttgaccgtccccatgatttaaagagccttgcccacttgacttatgtaccacatgttagccagtaatctgttgaacagattgtaattctcatgggtattttatagctaaactgaaaacaattttcagtcagacaacatatagaaaagatgcttgtgtagaaagcttgctgctcctacatctgctctgaggagagtgtatcatgtggcctctattctaatgacagctatttggatcaccagtggatccaattggatccagcaactggatcatctgccaccaaaactaagatctggtgagtagcttatggggcgacctgaactgaaagatttgtccaacgggacaaggataagtaatagattcactagattctctttctagaaaagtcgaatatacaacatatagagagtatacagccagtgaaagggatgacagaaagaaagagagagagcagaaaggaagaaaaggagggaggaaggcagagaagaatacagtaaaggaaggaagagaagaaactcaaaacaatggaggaagtggggtatgtttagaagcagctcttcataacgacaacaaataaaaacatctggccaacatgctgtgttctcttagatttggggatatttgtataaaagaaactcccttttcacagaaactaataagagaatatcaagtttagaatgtttcttctaaaactttcttggattttataatactttttacctaggcaattgttataatgccgactctcaacaattgaagagaatttgatcaatttggtcaacactcaagaatgttgcattactttgagagtctctgcagtatcaataatgcttaacgtgaataaattaataactgtgcttggtttcaacatgcattcttaaactgcacaagagtagtttttagaatatcacagcattttatatttgcatataagcaatcagtagattaatcattcactaaaatagaccaaagcaatctacttttcaaccactcacagtatcattctgttgcctaatccatgtagtcatctaaatatgcaatgaaagctgtattcttctttacaattctcataagtttaaacatgtggataatttaaatgggcttccatttattcatttatttttattcattttttttttttttttttttttttttttttgagaggagtcttgctctctcacccaggctggagtgcaatggcgcaaccttggctcagtgcaacctccgcctgccaggttcaagcaattctcctgcctcagcctcccaagtagctgggattataggcacctgccactatgccctgctagtttttttgtatttttagtagagacggggtttcaccatgctggtcaggctggtcctagaactcctgacctcaggtgatccacccgcctcagcctcccaaactgctgggattacaggcgtgagccacagcacccagcctcaatttcgatattattctaaagactcattgccatgtgccaatacactgcctgtttttatttgttttctgtcagaaatctatgttcattctttacattttacatgcaattttttttgatttttgctgaaaataataatttataaactttcttttcattcccttcacatatactttaagtaaaacaacacagaaacaacaacaaaaaacaacgagacttctgttttctttatttatactttgaacttcccttattccttgagcagcttctatcctaggcaggtggatagcaccagtcactgacaggcaatgactggcagaactccacaaatcaagtgactgctgtgtgaaggcagaggcgaaagactcccttttacagttttctgctctcaggcatcaagcagcgactctaaactgaatatttactttatgttaacaagctccagcccctagaaatttcctcatatctttttaagtagcttctcaaatggcagcctgatcaaagcaatctaatatggcttaagtgccagtggttgacattttgcattcttttattgctttccatttttatctacataaaaattggtgataactaatatccatttgatcttttcattctggtaataaaatggtaatacaaagatcttattatctactccagacatccatcaaagtacatttttcaaaaatatactatgtgaagtgtttcttccctatacccaagtcaaaagcgaggtcaagtacttgtccttagatgccccttctctccaatacttgggcactggactgcaaataggaattgaacttcagcccttgatgctttgttcacactaatgttatatgtaattgtgttgtctctgcctcttaaatacactattttctgtgagaagccaaaagtacttggaaggtctgcttaaatattttttttaactccagagtttttattcttctaagaagacaagaaaaaagataacggaagaaacaatactggaaatgaagaagtaagaagagtgaatcttaatagaaagaaaggaagtgcaggtaggtgggagaacagacaaatgtaataaggcataaagaaagccacataatgcaaacaaaacaagccccagagatcatgagtttattaaatctatttttatatggatgcagaagtgtccctgaggacgggtgtggtggctcacgcctgtaatcccagcactttgggaggccaaggcagacagatcacctgaggtcaggagttcgagacgagcccggccaacatggcaaaaccccatctctactaaaaatacaaaaattagccaggcatgctggtgcacgcctgtagttccagctacttggaaggctgaggtaggagaactgcttgaatctgggaggcggaggtttcagagagctgagattgcaccactgcactccagcctggatgagagagcaagagtccatctcataaataaataaataaataaataaataaataaataaataaataaaataaaataaacgaagtgtccctaagccttccagtgaacaagaaggtcattccgtaattatgccattgatttggaaaaacaaaaagaatagaaagcataagaaaaccaagaaacacaaaaggctccctgaatccactgaatccactgcatatttaaagtagttactgatatgacaattaggacttacctatagttgataggagcaagtttagttttcaaaatttcaatgtatttacacctcaaaagattataggtctaacgatttttaaggttaccagaagaagagagaaagaaaaaaatggcactacttaatcatgcagtacatcacaaaaaaggccaaattttcagaaaaaaaatacatagaaacacatagcctaatgagtttggatgtatcgtttggaattattgggcaccaaacttgaaattgagaccatcattataactctgagattgacattaggctatgtgctttggcagatataaagaatgcagaatgagactaatgtcctgtacagaacctactaacaatgcacttgagaaaatttcacaagcaatagaaaattctttttgcattctttatcatttttaaatgacttactaaagtcatttaatactatggaccaggcaagagactgtaaaacagtcatcttctcatgcaaataattcacgtgctagtcacaaaagcaccttgttcaatatgatttaaggtttcaacaatgatttgttaatatttagtttttgttagtacagatttctttgatgagttttaaaatagcctacaatttgtgttccttcgttaattcagatagttttttcctttttatgttaaaagaatgtgactgtacagtcccttcccatctacccttattaaagtatccttcactgtctaagaaagaaagaggaggcaagggtaatctgattgtccttctattcctatcctggacagaggagagtggtgagccatggataattcatttctgtgctcaccttgcagcccatggatttggaaacactgaccttaatctaatcccaaattgtagataaacatattttagcaatggtataagctaatgagcatcaataaactgagactcgtctgggattgtgtgcagtcacactctgtaatctgcaagatcaaaacatacatttggcagtgaaatggccattattcagagagacagctttttaaagaaagtaccctatctatagctgaaaataagcttttttatttttaaatgaaaagaggctctcttcttccatttaaggatgcttgacagcttttcttcccgggggggaaatggtagcaataaggaatttgacagagataatacttggaattcagatctggcctttctcagaggaaattttaacaaagggctgtgccctaacatgtccatggaaaactctgtcactgcatctaaactactgacacaagagtggctgaaaaagaaacattcattcaggtttgaatacatgtagctggaccctctaccctcctcacctcccacccatttttcactggcaaagattagatagtctgacactatgtatattttccatataaagtacaaatgctgtaaacttggcggtggggtagggaaagagaaaatgactataggaaacagcagcacaattttaagtaaaagtagaaaagtgtttctggggaagtttccattcaaacgtaataacttagagtttaatattagtctttaatgtaagataatcttttatgttttactttgtatatttcttgtgataattttcttaaaagatatcaattgaggtatttcatattaatttcacaatacagttgatagcttaggtatggcacaatttttagagataatggtgttatcggctgtgatttaataaacgtacattaattttctcagtctcagacaaacctatggctcacagaggacacatgtaataactcagtctttcattaaactgcaagttatactgagatacagatattgttaatttagtttttattgagtacaaaatgcactccaggtagaaatcactgctcatttaatcactgtgtgttaggtttgcattatctggaatgtaaattcctccctttcctcaaaggtgagtcttttttatggaacttgggtttcttactacacctgctccctattccccaaataaaacagaggcaaaggaaatgaaaatgttacctgttcattgaatgttctttccagtgactgctgtcaagttaaggaatgtgcagtcctgtccgatgtgtacactggaggctcacaatcattaattgaattcaagtatcacatactcattaaaaagggaaaacaattcactaaacagcaaaaacctttgtcctcaaaggtattattctgtggaatatccagaggaaaaataagactgtcctcaataccagagtctcatgatataagccaaatggcaaacgagtctaacaagggtaattatactataaacatacatttaaaaaatcattgatatagccacagaatacagaatcacatgtcatttgaataattttcattaattgctatactttgcatagttatattttgtaaattcaaaaattcatgccttgttgcatgcttcatataaataaaataaaaagagtacataaggtagaggtctagaaaggaatattggtccccacaaggattttctaagatgcaggagggatcaagaaaacctacagccagagtgaggcacagatctggctttggcaaagaatattttgtgagttgccactttgcctgcatctatgcccccagctgaaagcaaactggacctggtattagatgtgcaaaatgtatatccttttaggaatgcatggaggagatagagttggagaggagattacatatatttgaaaaattccgcttacgtgagagctttgacaggttattttcaggaactattttgttcgagatctttttaaatgcctgggatattggttataatttattaacttaatttttaataagtcatcattctgttacttttttattggtctgattgaacaaactcattttaatgttatttttaaaagaatattaaatatatgtggatagaattatgagttgtaagaggcacagtgtttgaaacagtacgtattttattaggaaaatagtcttgttttcgcaagtttaagacctctatttgttcctcagaggatgccttattgccacttgaaaacatggccaatgctgtggggagtagactccatcaactcacattcagcattgttttgagaatagaaaaaaattctttactgtgacagtgagagattagaaatttgttagaaccattttatttaaattgctgatgactttgtgttgtgatcattggagatttcttaatgtgatcagcaaaacctggaaagaaaaaacctgagcatttatgtacagaaataaataagtttacacttaagataatgccacaactcaaaataaaatcacagtccttatatcctttcagattttcatccaaattcaaagaaaactcagtccatgcatcttttcagactcatcagtttgcatgcatgtcacagatttgaagggttttggttatttttgcagagatatgattaggatgtaaaaattcatcatataaacattcttaatgatcaaggaagaacgttttagacgagtaattttctatgtctatgtaaaactttagatgggtttaatagtaactctcgaagtaagaggaattaagtatttttttttgtatttgagttaaaagataaagacaaaagaaaataagacccacaatattttctcctatttggttatgaagagaacaactggagtctaaaaatgccacttgcagtatctaaatgtctataaggtgctggcacattctgttacaaaacacttgtcacctctttttccatatagaggtaggaactgcagtgggaaagtcttcagctgtacaaatttaaaaatgaatttttacaacccagatgatggactggtatactttaaaagtgagctcatgagttttataaacacatttctcttgctctctctctctctttttcttgactagcttacatcataatggaggaataacattttaaaaattttgaataggcacttactggaattacagttaatcctgatacaatctagatggggaagaatagatgaaaaatgaaaattcatccttcaaggtaatagctgcagacatccaataaaattacagtccacccttccggggacagacacatgcaaatatggccactccatatcattattctttacatacttataaagcccagatgttttgttataaaagtttaccattggaaacaacaatagaaggttttaaaaatggccaattcaaacaaagctacatggtgacaaatctaagtgaagtaaagaattgttaaatgtcaaagatgtttggcttagactggctgcaactttctccccatctgtgaaagaacatatcattgttttccgcaaaatgtaaaagtgctccgtcacaatggggtacagtgcaggttcagctaggctcagacatcttggacctccgaaatctaatatcccacaaaggccaacagaatccttcagaattgcagtggtcaaatggaaagcaagttaaaattattcttatcttaccctaagggtttttgttttgtttttaaattttatttgcttgggcataaaaaggtaactgccagatgttggctggattccataccttgcgttaattggaggaggaaagaaacaactgtatgtttcctttagaaactccagtggctaaggagcagtcattattcaaggcacacaagcctatgcctctcttaggagctaacagtgttatctctgtgtaataagtgtcgtggttcccttgattttcctttcttgattttccctttcttatatttgctttatataaaagtagctactataagaacagaacgtcttgtatgggtaacacaaactgtaattatagtggttatttttaaaagactgtaggatgtttcatatttattttatatgtatttgttggtttgggttttattatttaatgcctttggagaacataaaaaaataaacctagattctgtttccatatagctgagtttgtcatgtgtcgtcaaccgcatcagaaaagtggttgcaaacagccaaggaccagcacctacacacctctttctacagaatgctttgctgttcgaaaattctcatgagtgtttccactttgactaacagcagctttactgcatgcaattaggcgatttgttttgattggcttgtaataacctgtcatcgtcactagagggtactctaacagaacagtaaaggagagtgctctgtgttcttaaagtagtatttttttaaccttaatatttaacttaatttcactaatattaattaaatatgattatatgcaataagataccaatgggataattttatattttatgagttatcgttctgcccagcacaatttgaaaatgtaggtggggtttccacaaatgccttgcctcatcacattttattactccttttttggggtaaatctatgtagtttcaaatttcatttttccctctctgtttattcatttctatatacgtgtgtttaacactgtcaaaaatacagtaaaacctcattaattttgactcctcttattttgaaataatgataacactgaaaatttgggcagagtatttattcttcctttgatatgagcaaagatctcttaagaaaaaaaattaaactcataaacaaacaagactttgaaaagccaagcgtgggaagaaaactgatttccaatacttcatgttgatggcatagtttgcatgaaacgatgtgctaattataattaatttttatccaaccattaaaatcagcctagagagccctttccgtgataagactttccaaactattatgtttttgagtataatttataaaaataaaaactgcttaaacaaattttaaaatctgcaattcagactttttcctaattcagcctggtttttccccataattcatctagattggtgaggttttactgtaatgggtctttcttaatgctacaattaagcaggaaagcattatctttctgtagaagagcctgtgtctctagtgttctcatggctgtttgctaagggccgcagactttgggcattgaagggctgtggatcgctgtttgatagcaaaataccaccacacagtactccgaaacagaaaagacagggtaccacaaaggtgattattcaaaggagaagcccatggagtagagtaagaacagctcttgatctagataacaaagcagaaatttgatattttgtgcaaatcctttctaagaagacatgcttttatttatctgcaaggatgtcacctacaaccgatccaaatgtcagtgaatatatcaacagaaaattcagcttgaggcaacctcaggcttaataatttatattttcaattaacctcactgacagacatggcctctcttttaagaaccctcagtggtagaaatcacaaaacagtaagttatgttaaacataaaaaataaaataaaaaataaaaagatgcccccgaaaacctcaaattactttaaatgatggaaataagaccattaagtgttttaattttccatggcaaacaggctacttgatcaatgtttgcaggcaaattgaacaaaaagtaaaaaagtgttagttcaatgggggaaggcaggttgttacctagattgaccgtcagtttcacacgtcctgcgtctagctccaggcggagggtgtcagcagagtctctagaagtggttgccatcagaatgccatatgcacgctgggatcggaaccgtaaggaaacatcctcagcctccgtatgcatgactacggggagctgaattttcataaacatgctcccatcatagctcaaaaccgttgcctctagagatggaaaatgaatatgataagttcttggatggtatagcgcattaatactttaaagaggaaaaggatcatttattatcatttatttaagacttccagaacacaatactacaaaatcaattcatcttcttcagaaataaacaaaactgtgagctggaaagagaagtcacagtagaggacttcccttgtgagatatttgctaaagcccagaaacagagatatcagcagttcctttttttttgttcccagagcactttctacctatagcattaatcatgttgaattttgagtgtttgattatatgccccccttctcaagagcaaagatcacgttcttttgtacagccacagtgtgagcctagtttgaaacaccagcgaagttgtggatttttttgttgttgtttttgtttgggttttgttgttgtttgtttgtttgagacaaggtctgtatcccctaggctggagtgcagtgacaggatctcagctcactgcagccatgacctcctgagctcaagcaatctttccacctcaacctcctgagtagctgggaccacaggcgcatgacaccatgccaggctagcttattattaatacttttttctagagatgggtctccctttgttgccaaggctggtctcaaactcctggactccagtgaccctctcgcccaggttcccaaaaggaacctgtgcccagcctccagcaacttttcaatgcatgtttatgtatggtaagcccactgactagttctgtgaaattagtcaaccttgccttggctctgaattattcatctgcacaatgagagggtactgccagaaggtttctcagggctttgatctgttctgaaaacctgtagttctaggagaagttactgtcatcatttttttttcataatctctgccctgatagaattatttttaaaagaaaaaaaaaagaaatatagcttaactataggaactaggccaatactttaccaaaggtgatgttcaaaaagaaaaaagaaaaactgatattaccaaacaacagataatacttcttttgagccattatgtttagcaaggtaatttttacaaaggcttccttttaaggaactgttacttccttttaagattaatttatagaaggggagtaactttaaatattatctataagcacagccctggtgtcctgaataagttctcatgcaaagcagtaatgatgtgcttttgctacactaaataagcatgggggtgggactggggagcttgtgaggatgtttgttactaaactaaggcagatggcatcagtagggaagttgcttagtactgtcttaaacacacaaagaaatgaataaaaaaaaaactgttgatgacaacctgacggctttaagaaatagtcaggactccttaatgttaagcaccatatggtagtggaatattgcaaaacaagcgtgaatcagtttgctttctcattggttccgataactcaggatgctacttaataaagaaaaactacctggaattaaaatgaaccaggaaattttcattattttgcctacttacacagcatagcaattaagtgtactgatacaactgtgttcaatattaggactatatttagagttgtggttttgtaagtttatttttcagaaagtcaagtactgtttctataagactttaatcactatttgttgtcatgatgggattaagtgagaaccagaacctctctaagcactgagtgttccaggtctccctgcttaggttagctcccttctcttttccatctacctcttgacttaagagatctcagtcaactcatatgctcactcctctaatatttattaagcgttctgacttctctcctgagctgtagcattcattgcctattggaaattttcaattggaatatgaaatttcaattggaatatttcaattggaatattattaaactcttgatttactcccttcaaaaatgaacaaactcaaaacatgctccttcttcagtcttctccatctcagtaaacatgataatctcattgctcagacctaaagctttctgatttctcttactctctctgccatgtccaatccatttgcaagtctgcaagtcctaaaggctctaattccaatccacattctgaattgattgctgttcacctctgccactaatgtccctcagactttgctctcatctctcacctacaccactgtagtagctccctcaaccgtgttcctacttttttaaacctacaaagatcagtgtgaccctggccccagtccatctctctggcctcagctttaagtatgtcccgcttcttgttcagtgagctccagatacaccaatttcatgatctcactgaagtgtttgcacttttagatccctctgtttaaaaatgtttcaccccagatctttaaatagctggttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatatgtaataaggtccactttgaaggccaaaattgggctgcagaagataggctagggaagtgtctatttatcaaaacaggggcctcatggttaggcaatgccctaagcactgataaaacaaaatatggtctttcaaaaatatagtggttctatataatatcatatttttttccaattagacaaaaagtttcccaaatgggagtaaaatcccagtggtcaaagaccagtgcaaataatcaaattgctgttgctcaaaaaataatgaaaacctgagtgtaaagttatagtgaattctagagagaaaaatgcttgtggtataattttaaaagaaatttgatctttacttttgtttttcctaaactagacaatcatgacccatatctgtaaagcaacaagcacccgaataaaagtgtaaaagtcattatcatgtgttcagttactttggtttcatatagataaaaggatcaaaacagtgtttgttttctcttctttatttaatctctataactaggctctattattcaataatcacatttttgaaataatcatattcttctgggaaaagtagcttgatttgattgaaaactaaatagggggcacctcctttaagaaatacagatgactgacaatggatcataaatatagtgtgaaatacaacccagagaaaaaaataatcagaatcattagcctttaacattctccagaaagctgcaggactgaaataacatagtaaagtaataaaactagagtgcccccgagtgtcatgttaaataattctcaatgtgaaaataacttgttgataaatgacaaatgaaagcctaaacgattcctcacaattagagttaatgtttaattagacaagaaatggaaaatgcacagggttgtagtctagagttgccaaataaatggtaaacaacattctgacatttgaaggttatgctatttggcagcatccttgaacactagtaaaattatttcatcatttagaatatacaataattctttaaaaggctaattccaatacaatacttcccactgggggagaaaaccagtttcaactttgtcttctatatctccttctcccttgtcattaagtttgataaatttccttttctacattattctttgttgcagtctaaagtgtacacctgtgctcagttttgccgaaaggcagtcacatattgtgatcaacgatgaaaatcagacagggagccaaattatattgctctgacatctgtccctccatctgttagaatttaacaaacagtataaagcagatctctgattatatcaatgctcttattcttacatataacagaataatttttatatgatcaagtctccacaaattctcagttttattaaaaataaagcagaagggaaggcgctaaatttaacttttattcattgaacattatttctgtactactccttcttataggatcaatacatgtaaaacaaaatactctcttcttgtctgcctaagttagcaagtatcttattctttcttataaactcctttgcttccttaggcatgataaacatctcctataatgcaattgcaacataatttttccatgttgaactttctaaatccaaggagctgaacatgttttttaattactttgaataattattttcataaattataaattatcaatttttgctcaaagttaataagaaaacaactttaaaagttctcttaaaaaaagaaacttcaagagttgtcaactcttatttgatcaacaacagccttaagtgaccaatgtgtgtctggagaagaaactctgtcaaagccccctgttttaaattggaaattcggaggttcaggcacaatcttgtgttaactgaactagggcataatagccacgaactgggcagaagccaaattttgtggtattgagcatgacaaccatcacacatttcctttgctttcaggaggcaccctaacgtgagcaagaaaattacttctgaaaagcaaaggactcacgcaatacacatgggtagtccagtaacaagaaccacccaaaaatgcatacagccaacctggagacaaagaaatctgcagaaacctgcagcctcctatcagataaagacgtatgctgaatcccaatgatgaagtttgctattaaattctcatttacaaatctacatatgcttgctgcccctttttctaatcattgcaatatataaatatttcttctctcatcctggctctgaaagatctacaatttctattttcatttttgccataggtagtagcggaatattgccacagggtggtacaccacgcatagttaacagaaagcttccgtaattcatgtgacagttgagttatacccttttttcagcttcacttaaccaagaggcatcagaacaactggcagctctctgggtgattaaaattaaaacaaaaccttaaatcgtgcaagtccgctaatctcatattatgcgtaactgtattataccttgcaagctttgttacattgttcatccttttggcaatttccaaaaacaaaactaaacaaacaaactaaaattaggaagcaaaatgcaaagaggaaacttataaagaatatacaccatactaactaaactatatagaaatagctaagttgtattgacaattcacagaaatgccggttaggtactatcataaagagaatgaatatatctgtatctatgtgataacatacccgtctactgacccatctaattgcatgacctacaataataacagcatatggtaagtggtttaatatatgatttctatgttactattaaatatttatattgttaatattaatctcagaactaataagttgatgtacctcctttttaagataaataaccaaaatcaggtttcaattttgggtttcacaaaacaacccctctttttcctaggaggttttcggcaaactgaactgaactatttcaggaataaaaaagggaaacaataaatattcatagcttaaaaatagatgccaggtaattttaggctaaatatgtaataaagcaatgttatttgtagcaggtgaggacaatggaacaactcatcaatattttttcatattgatttttagttccattgttgaaaataagtggcaataggtgtagtgactaaagcatttatctgaaacactgggtcgatggaagaataaacttagaactatttgttctgctatttattcctttagcctgttctgcagatcaactgggatggctattgcccttcagttttctttgaatcctcattccttttattgtatagggtgaaaaaaaagaaaaataaaatgtgggtttgcctcctgttagaaaaagagaggcagcacctgctcagaacttcaataggcacagctaagtcttaacagcaaattggtaaatgaatcctctgcagttggttaggtcctagccaaaggtaagtactttttctattagggtacacttccagaaatgttggtgcaccttagatgattgaaagtcagcttacttttcagagaggatattgcctcttttgtaagttgactgaagtgaaatgagcaggctaacttaagtctcacccagttgtgtcagggaagttgcaactcatagcttagcttgcctcaaatgctatttcttagcatgggtattagcactagaagccataggtatgtataattcatgcctcttttactgtctaatgttctgaagttaaaaactgggcaaaaaagacagcagttactgtctataatacatcttaggctcatactctagaggatactaaagattcaagtttctattcctgcaatatacttaagaactgtgtcctttcagaatcaagctctttgaaaaacattaagagctcattagtaatccatgtcaggtatggctgctcagcttgcaaacagagtttacttcagtagagtatacattacgtttcaatggtcagtgcaggtttgaggtcaacatttaataaacttttcatctcagggagttggctgctggggttttagaatcctacctctctcacaggacctgccaagatagcctgttccggaacaatcacagacatatctgttccacccatccctgcacatgccattgtttttgcaagggttgctaaggcacggttttgctgtttcctttgagcaggaaggcttcactccagcagtactttgaacttcagccatttgccggatatctttgctttggccatcgatgaacaaatccctgatgcagcccacgtagccatagttgagcagagcagtccacacctcggtggggaagacaaggccagctttattttctggcagcccccccaggtacaactcatcatccaggtccagaatctcactctcaccaggagcagtgtagggagtacgcaacgtgttgacagaaatggtacctatttcaaagagaggagaatgcacaggtctttaaaaagcaccaacgtgttataattatctttctctctttcgtctgcttgatggttaactccttggaggcagacaattattattattctttctgtcctcactttttggtatttcctagagaaattaagatatctgtggtattaagaaactttagaaataaaacagactaaatggttccatttgaactcgagaatggaaacctaagtgtacagccaacaaatagtgtttgagagcctcaaacagttcagtcaatgcatgtatacatacattaaaaataaagaaactgtaattctgtatcagtctctagaagaaagtcagattcccctgggttagtgcttgttttcaaagccaatattcaattgcaatccaaagaaagatttcatgttcctattttaactgacttgattactttgattgagcacaatagtttcacagattacctatgtcaaaacctgacttcatcactcctagctgtataaacctattgattaacttacatagttttgtttcccttactcataatatgcgcataataatattacctaccttatagagttgctcttagtgttaaacaaaataatactagtaatgtacatggtttataataatcactgtataaatgtttgtgattatatttcagtgaaagaatcaagtaaaaccaattgcttccttatttgtaaaccaagctagttatttatttaaattaacaaggctttctttttctcactccaaatgttaaggagaaaaatctattggtttataaatacaagggctctaagtcctaagtatggaataaccaggtattcatctacatgggatcatttgagggtcacagaaaaatattagtggaatctatgaaaaaaaaagaaagatataaagcatattcctgatcaaaacgtgcatacacactgtcagattaccaaaattccactgatactttatcttcagaaagacctttgtacaaatgcaaccatgatacctgaacagaacaccacaaggacccacaaccacattatcccagatttatttctcagctccagattataagaaaggataggaagagtctgatgagagagagaggatgagaaaaggtctgatagcatgctggggcatgggtatagaacctcaggtatttagggaagagacacaagagagacctggagatgggaggtgtgatacagaagtaaggacaaaaagaagaagtggagggtaggtcaggtgtgtgtagggagacacattttagttgctacacagaataccaaaagcccgccccaagtgaaaacacatatctaactaaggatgtaaggctgtgggccctgatgtgcccaggagtattccaaatcccagcagaagggcccccttcaatctaggcagtctaatgggatctgtctttgtcagggagaagggcatggaagccactgacaaagactgctcaggtggccgagtcattaagaggatatttggctctctagactttcagagaaagaaaagggaaaagctcctaggggagaaacactcaaaggcattgctattttggccttccaatgaggggagcaaaatagagatttcctagggaagcagctaaaagagaaaaggacaaagtattcatttttactgttcacatttgtacaagtgtctagaagaaaactctcatttaggaacatatgggaaccataaaatcctatttagaaaaatataaagcatggcattttggggaaataaaatttataatattgaaagagaatggtggctcttttctatttcaaatggaacgatcattacacgcattttaaagcatcattttttatatagccctattcaaaatacctaagaagcgaataaacagatggtccctatcctctgcagtagctaatgaaagttagaatatgatgagaaagagtgtcttttaatgacaaaaggaaaggtggacactttaaaaagcacatattatcatggaaagcaaagagttacatgcaatgaacaaagtgccatgttctttttttttttctttctgagacagagtcttactctgtcacacaagctggagtgcagtggcaggatcttggctcactacaacctctgccacctgctttaagcaactctcatgccgcagcctcccaagtagctgggattacaggtgtacgccatcacagccaactaatttttgtattttcagtagagatggagttttgcaatgttggccaggttggtcttgaattcatggcctcaagtgatccacccaccttggcctcccaaagtgctgggattacaggcgtgagccaccacacccagccaaagtgacatgttcttaaataaaagagagaaggattctactctattttccaattagttcaataaggcctcctaaaagccgtagaatttttgaggatttgacgaaatgaatatccactattgagaaattgagaagaaatgttaggagacacggaacttagcaaaggaacaatgacaaattattccaagtgtggtgatatattcaaatatacatatatataaacatatatgtatgtatgtattcccatatgctctttttattcagctcagatggggaaaaaagccctgggaaaggctgtactgtccttgctcagggtatcgtaattctgacactaagaggactcctggaggactcctgagtcgaggaaattcattggcttccacaacccactttctccctctattccatgtagtttccataccttggtgcactgtgtctgcactcactctaaggggcaaaacggctgccaggtggtttagacaatcattcattacagtttgtctgacagtaaggatggagtaactgtgtctcttgatttttatttatggtgtgttagtgcttgctttgagcaaagtattgtaagagagttcaaataagttattttaagaatgtgcttgatgatatggacagggtaagattcttactacaaatttatcattagacttgagttttctgaacacggtcatagagaccacaattttcaaatatcccagtgcacacttaaacacacatccacccacccacccacacccacacacacactctgaaacaaatgtttaaaagaaaaaaaaaatattcaactctacagcctctgaagcactttgatattttctctctcatcatatcattttattaaaacaaatgctggaccatcaatggattttagcaccagctaaaatgttgtaacccatggtacaaaaaaataaataaaaaacaaaaacagatttaagggttactatcataaagagtaagtttctcccatagttccctattgtccctttgagagacaattgtagagttctcatagaaagaacaagcaggccaggcgtggtggctcatgcctgtaatcccagcactttgggagaccaaggcgggtggatcacctgaggtcaggagttcgagaccagcctgaccaacatggagaaaccccatctctactaaaaatacaaaattagccgggcacggtggtgcatgcctgtaatctcagctactcgggaggctgaggcaggagaatcgcttgaacctgggaggcagaggttgcggtgagccgagatcacgccattgcactccagcctgggcaaccagagcaaaactccatcagaaagaaagaaagagagagagagagagatagagaacaagcaacaaaacatgagacagaaagaaaaagggatataatcctacctttaattcaaatttaatccaagaaagactagaacttaaattgagctctggattcaaagttaaggagacacatcaggcaaatggatggatcagatatcagtcattggaatattatgcaaacagacatcataggatgaagaaaatagggctgaaaatcaagtactactttatctatatgctttgctaattcgtatgaacttgtattttagaaaatctttgtaaaagagatggcaaataatcagaaagtaaagaatttagttcaagtgggatggaaacaattatttttatattttgaaaattcatggagtaaaaatggttagaattaataattaaattttattactgagacaaatgcaaatagaagtttatattttagcctaaacatgtgtcctgaaatagacacatttccaataagggatttgaatcccagacctccttaatgacttttactatggatatgaatcaaagaacatattcacctagcaaaagagtcatcacagaatccgaattagtttaaaccaatttaactcatagatatgagcatagtgaaatttaaatattaaggttcccgtgtgcttattttattaaaattgagttataaaatcagtggttacaaagaacacatcaaattaatatttaaacctggttcattgataattgaagacaattgagtagttgccaaactctatatatcaatggaaaaggagaattttcaaaggctgaggtacataaatgttataaatacatttttaagagaaaacaaaaatctaaatatattaatgggtcatccctctatctttttccaggaaccacaaatactgacatgttcttttttaaatagtttgattccttcatacattctaccccttctactgaatttatatttgcagtttctggtaaattaacaaaatattttatgtaaacattgttacattaaggctcctaaaattggggaaaagttcatatttgagaaattatctagatcagggtttcatgcttcactatttaagaatctgaagcaccctgctatgctattttattttttaaaggaatgagatcgcaactaaaaataaattatttgtggacatacaacttttataattttaatgtagaaacgacattacattatattcttacatgtaaagctgttttttcacgacacatgtaagaggtaaaatgaaggtgataagcagacaaggtaatatttaagaatattcataaacaagtaataaatttatgtttcttgtaaaactgtatgcaaaggttcaaaaaactttttaaaacagctcttagttataaaagtggaaatgaaatttacaacgtagtgaggtagtttttcattacctattagtttccattaacttttctatcctatttttattgtctgttctacttccataagattagtttacagggtgagaagaaacacagagtgaaggtgagatttaaaataagttaagttgatgtcaagagttaaattacttcacaagtttaaattactaggaaatgaggagtagaaaatagtgtgctgtaatagggaaccctttttcctggtgagaaaatccgatgttccagctcttcaactaactagctagcaagtttagccaaaggatagatctgttaggcttcaatgtggctcttatgaaaaataaagaaattcagtagatggattattaagattcatttttgaataaacaatctttaaattactgcttaaatgaattgtttaaattaatgtcaattttatctatacttaattctgctccacctgtccctacacaaatgaatcagatttcacaaagttacaaatttacttgtcaaattcctagtctaataacaaattcaaacttgatgaaatatgcacaacataagtaataaaaacagaatacaacattgacaatagggtataatgtaaaatgtaaaatatataattatcataaaataattttaaaaaagaaccaacatattaagagtgggtatttggtgacagtgtaattatgagtgttatttaaaaaatttctgtatcttttttaaaaccaatgttatctatgaggtttttaaagaaataaaattaactgtatttgaaaacaaaacaaaaataccatcttaatattccactctctgcttattaccatctgttttctgcttacttgattcatctgtgagctgggaacttcaggaattaaatcaatatatgaaaacagaactctaatgacaaaaatttaaaagtttaataatgtctggtattggcaagaataagggggaaagggcacttcaataactgtagataagaatgtaaattgaaacagcagttagtaaactaacctgtcattgtctttcaaaattaaaattacaattaatccagcaatcccaattctcacattcaatcctagagatattctgaccaatatacacaaagatttcatgtatgaaggaattatctataaactagtttaaaacagtgaaggtttaaaaaagtaaaaattcaaatgttcttccatagagaaatgcctaaatatcagtatgttcaaactaaggtatgtatggtgtcactacaaagaatggcacagaaaaagctatctttaagtttttttgttacacagtaattggtaaactataatcttgactatagaaaaaaggctgtataagtattttatgtgtgtgaacatatttatagatatattgatgcctagaagaagaactgggaatttttcaacgccaaattattttagtggttatctatggagaacagagtaaattgatgagggaatgtatggtaaggggaaacgcttcacttagctagtttttgaattgcctgaacgtgttcaccaaaagtatgtatttatatattaaatacatcatgcattacaaaaatgcacatatataaacacacatacacattcacagcaatgtatagacacatatacattttaaacatgatcatacacaatggaaggttgtaaatatcaatcaaataacattctgcagcaattgaaatattattttgcagaagttccacagatttccactcagcattccacagtaagggtcactaggtccgcgtgtggtcagtaaactgcctatcttcttagggtgctactgatgccatagtccagagtctgccccttagctaggcaagcccaatgaagagatttggtagattttcagagggcggtttcatttcccaggtttgactgatatttactaactccataacagcaatgtataaaacaagaatgccaagttattgatttcctctgaggaattacctattacaggacatgaaatacttcccatgtagctctgccaatatggatgtcaattataatcaaatattacttattcatttatgatgagaaatttacttgttacaggaatgtgaatactcatatgcattcctcagtatctgtggaaattggttccaggatctcctggagacaccaaaatctgtggatacttgagttcctgatacaaaatggcttagtatttgcatataacctatgcacatcctcccatgtactttaaatcatctctaaactacttatatctaatacaatgtaaatgctacatagttattatactgcattgtttaagaaacaatgacaagaaaaaatgtctgtatatattcagagcagactcaatttttttccaattattttcaatccatagttgattgaatccacagatgcaaaacccacaaaaaatggggggccgggccgactgtatacataactggtctattttctccctccactctaatcagacttacaatgggaactaaatcttaatcaaaagagtgcatggggaacatggattctgaacaagaagaatgcatgagataaggaaatgtatagtaatattggcctgggaaggcttgacacccttatctcagttaaatgacctgcctccatctttacagtggggatgaagttgtcaagttcgctaagcagtgttcagaagattactgctaatatttgcccctgtgagtttcttttctttagatatgttaatacatttaagttctacaagcccaggggcctagctcaggtacttctgaaaagctctgctctgaatctttgcttatgattccataattcccagaaaataaattttgctacttagatgatcttgagcaaaagagtacataacaccatattaaacagatagcctgaaaaattatgtttatactctaactgcaactatataaaatatatataatgttaacaaaaactgaaggaaaatgtacaaatataaaaaatactttgagtgtggagaaacaataaatgatttttttctataaacttcttcagaataaataaatataaacattttaataaaacttaacattacaattttaagcaaaattgaccccatctggtcatatgatcaaagaactagtaaattattggtaaggtatttcggtgtttcctctgatgaatagtggtttatgggtgtggatatgaaacaaaatataaatgcacttaaaattacttcaatgtatataacaggctactaggcagaggcatgggaggaacatttacagtcagagggcaagttcaaacaagacctaagcagagaaattgtctaatggttgctcaagtagaaatgtttaagtgtggtgattcatgaatggtgtacacagaaatcagtgctggtaatagatagctagaaagtgctgttcacatcaaacagtgattactataaacctctaattatgtgctcttgagagagccttgtacctttcccactgtaatatctagttcttaaactggaactctacgacttcaattcaaatctcaatggcttcttagctgttaaatgtaggcttacccatgaataaccgctgacacaatcagctgtaccctgctgtatacaagccaactttgacaagaataatgagttttctctttgatttcaatgtgtaatgatggtttacaaaataaataaataaataaataaaataagactggcagtttgctataaaaatacttgagagggtactttgactgagccagagtttaacacaaatttaaacaatatttgtgccccaagaaaacaatcattaacctcatcctaattgtagctccattcacagtttagctaaatacctgggcagctgttttgtgttgagggtgggaccagagaagaggcaaaggggaagtctggaaagagagagactggtttaaaaacaacaacaacaacaaaaacgctcagctgtaagtcctgcaaaaattgcaaagtaatgggcctcttcaatcatatttattaagtccactgacttaggggttttgccctgttagtagctaagttatccacagaggttatttacattttgcagcactgaagtcatccactctgattcactaaatcatgcctgcacttggtatggtttctcctttgctagcttactgcaggatctggaagtgccatttacggctcagcccacttggctttccatgtccctgaccctttagtgagcaggcagtggaagaaagctgcactgcacataaagaacagctatagccaagcagaattagtcaaactgtggaaattagagtgaattttccccatgtctcagattggaagaaggaacatatgttagaaataaccagttacaatcagttttgccaaaatgagaaagttttagaaaattacacataaaggtgttatttctcattgaataaggggttcatatacccctttcagtgaactaaagaccaaagaaccaaagggaaggccaccaaaaagatggacatcctaggttcttgtcaagagcacacttactgtggttgcatatcccagtcctcagaaaggagttaccaccttccttcttgatggattttcctgctccctaaatgtctgcaaaatgatatagggacctcaagaccaagaagggacagaagtcctgttctcataaaaacttgtcatttttgtaccaggtttacacattcgctaacaattatttaactttctcagtggcttatttcaaacatctgggcttggaggatggtgttgcattcacaagagaacaccagtttttatcctatatcatataaactgctttcagaaagtaatgtaatttaaataaatgcttacagttaaaaaagttgcatttacaattaaaagagtgccattattctccaaatgtaaaaaatgatgctgctaatttattttattttatttttttttagagtatcaggggttgtttggcactgtactacttacatgtttttaatctttagtttttcttataccaaatatatactgaacaactgctatacccaggaatgtactagaaactgtggataaaaaaataaatacaattttctctatctgggatggaaattatgaaccttataaagtgggtaatattaaaattaaatcatttgtgtccaccaaatatgattttaaccctctctctatccaaaaataaccactacttagattggcagcaaattaatgaccataatggtctcattatatttctatttactttagtatggccaacagcagaaagaattgctcttaggcgtgggttccctctactttaataacagagataataaggcttttaaaatactgagctaaggaatattccaggcaaatcaacagatatggcctcattatctgtatgtcagaaaggagcccatgttaccctcttgtcatagcagtacactttctccacattatatgaaaaataatattcatatagcccctgaatataactgatataaaaaatgggtaaaataaattatttcatgaaatttccatgtttcttagttgtaagtgacctctgaatcttactgtttcaccagccaaatcagaaatatcctttaagtaaaataaaagcaagtatagccattcattcaatttttaaaaggctactccataccaaaccaatgcagtgtgcaaatatggaacttaattaaaatactatatataaaatattaacagctgctattaaaattacattaaacacccttgagctaggctaacctaatatgagctctattttttttcaatttaataaaggacagaacttggcttagtgaatgaactttggtttttatattgtttgtaccaattcactaatctgaaattttaatcacataaaagtactttaccatcacaacagcaccaagcatagtaatctgatctttccactggattcaaagaaaaatctcatgcttcgtttattttctttcttagatgcaaacaacacttccttagaacgtgtttctgttcttcccatacagaattgagctttgtaaattaaagtagatatcatctaattttgaccttctccaatgagggtacaaatagagtaattaataaactcttggtaatttggatgaattaaagagcttaaacagaaaaagtagattttattctgcttgaagattaaagtatttatctgataattaattagattgcatcaatactttctccttataataagaaacctcataaaatattcaaaataattttgttctctgtgagtatgtgtatatgtgcatgtgtggcatgtatgtacatatgcatatatatacatacatatacacatatacatgtagagagagacatgcacacatatatagacacacacacaatttacatagaagaaagactggaaagaaatacccaaaaatataaatcattattttcaaatgaataatgaatactttcctttttcttttatattattttgtatttactagtattttgaattaatcgtgtattacattcatatagttagaaaattcctcatttctaagtgaatgaaaagcaattgatttgatgtttggtgttttttttctcctctgaactttcagaagataaccgtctaatctgatatgggttgttttgtgttgttttgttgttttgagacaaggtcttgctctgttgcccaggctggagtgcaatggtatgatcacggctcactgcagcctggaactcttgggctcaagtgatcctaagtgtggggattacaggtgtgaaccactatttttggcatgttttgttttaaagtgctataaaatctgacttaaaatatctcttcttgaaagtaattttcaaaattttattctagatctatcttaagtcaaattataacatccacaagctaatatttcaaagcactacataagcccatgcccacgccacttcaaaattcttctgcttgaaagttcatatgtaccaaattaactgctatctctggcagagataggctggaggaagtcagaggggaacactctattattattgttatatttttgcattcccatcaatgaactcttctcagcttatttttatttttattttttatttttttttatttttgagacagtctcactctatctcccaggctggagtgccgcggcccgatctcggctcactgcaaaatccgcctcccagcttcatgccattctcctgcctcagcctcccgagtggctgggactacaggcaccgccaccacgcccgactaatttttttgtatttttagtagagacggggtttcaccatgttagccaggatggtctggatctcctgacctcgtgatctgcctgccttggcctcccaaagtgctgggattacgggcgtgagccaccgcgcccagcctcttctcagcttaaatcagaaagaagaggaggaggaagaggaagaggaagaggaagaggaagaggaagaggaagaagaagaagaagaagaagaagaggaggaggaggaggaggaggaggaggagggagggggagggggagggggagggggaggaagaaaaaatggtaattcaattccttgtagacttctttaggaaagtgagaatatttagggagacaaagtttccagagaggaatgaatcagaaacacagtctccaatatatctgggaatcagagtaatgggttctgaccttccttctctccacactcactcccaactccttctcaatttccatatattctatttctttattttgttaggtaaaaaacatatttccaaacaggcaaacacaatcttcttgatctataaacagcagaataaaaaaggaaggataagagggaagtagaaaatagttcagctgggagttaacaagtactgagggagcccatgcaaggagggtatgagcaagagagttcagccccaggtcttcaacagggcccttctgaaagaccatggttatcacagattactgagtctaaaagaagcactcagcttagttggttgggggtgggtgaagtaaagaaggagagtagataggtctaaatttagttatcttctattataagatcatttgatttatgtatgagtaggacaatcagagcatgggagcccggggtgaagggaattaaataaatgtagttgtatacttaaaacagatttctctctccttatctctccctgtctgtctgcctctttctccctctcttctctctctctctcttcctccctccttccctctctttctcaggattcctacaaatgtcatctctgcttcctggatgattatttcccctcaaagctcatattagtcaacatcctaagccccctaaaacactcccaaatttcagtgtaaatgtgatttcttcggagaaactttacctgccacctttacccctcctctcttagagaaataaaatgcagcaacaggaagcagaatgtttgctggtggaattccaaatacctttcatcagaaagggaagcagtttggaagggcagcagagctttgccactgtccttgaaatgctactgtattgattaaagtgtttttaatgccatagactcatcctaaagtgtgacgtgccaaactaaggattttatgtttggatcattctaatttttttttcatattttatatttgccacttcgggtacctccaaacatccaataacataagagaaaactgggaatagaaaaactttgaattttttcacttgcaaattcaagacaaaattttctgcaagatttggcacttgattacccaataaaagttcatttaagaagctattttagaagacatttgagcatttggggtttgatgcccaactatgataattaattagctctttctttcatggtgtgaaacagaagcaatatcaggcaatttcttttaggctaaagaaacaaatgcaggaagtctttaatatgtcttggttttcacttttaggaatggcatgggtgggtggggtgctccagcagataaacagcatagaaaaatgataagattacctgaccgtccgtctctctggaagtccacatgataccattctccatcattcactttcttcaacagggcttttatttttatagtacctgaccccatgtccaggaggaggtagaggtggccatctagcatctcaatagcaaagaagtccacctttatcatctgtgggtgcttggcatctttctgatgtcttggcttgccatggctaaataagatgaggccatttggctctgttgtacggaaatcaaatgatatggagccagttttctttgcattccatttaggcaaagagatgaaagactctggggtttcaaaggtgattgggtctaaagttgcaacattctcacatttaaatgccaccactccatggatcttcatcttaggatctccttgcttggcaagtcgagataattccagcctcacatcattatttttatatacaacctgtgggcagaggatagcagtgagaaactagcctccatattttaatatctgaaacttgtgaacagctcatgtaactttcaacgacatcataaaaaggcacacgatatttagttaattttgttgtataaaggcaacatttctcaggcaaataaaattcaagtgtcaattcatagaacaataaccataacaacttaacttgattcaaataatgtgtgtgcagatgcacccgcgcatgtgcatatacacacaaactgcttgtatttaactcaaataatttaaaaatctgcatatatctttaatttcatgtctacattaccatgctaagacttgaacttataaaagctacttgtttcatagttgtctatgatatttttaaaattaaatataagcactgaggttattcagttttcccatcattaaagcatttgaaattggataccattatataccagtcccctaaaatattggatctcttctattatctatatatctgctgtggatattgactttgcaagacagtcacaacaagttaaagcacaaaacagcctgacatttctcagaaaaaaaatatataactaagatacagaagatccctgacctgcatcaatacctttgaatactgttaagtaatgtggcactgccacatgtagaatatggtgcttcccctcaatttattcaacctgtgttactggtgatccatttcacttttaatttacacaaatgctgcgcaagggttgtcttgtactctcattttccaaggcacttcagtgaaagaggctaggcacttctgagtgcttactgatggtcctaaggctttttggattccaattaacacatttgataattcactgacagggttcacggtatcatacatttgctatcccttcacgctaataaattcaaaggtattttgacataaggataaagagagaaggacaccttttctctacaaaatgcatacagtggataatcacatttctaaaatacatagaccatacttacttgagggtgaattagttatctaggtccacatagctgtctaggctctttcaagaagggactctatagatttcaaagctcccaacattgctagactctagatttatttatccacatgtaaaaatgtacatatatatatatgtatatgtatacacacatgtatgttttgtttttcatttttcaggaatggcatgggtgttttatataatatatgtaacaggaaaaataagacagcctgtatctgattagcgctatgaagtcaaccaagacaacgcagcagttattccaaacccatggccaactgaaccaagagatggctgatgagtttcctgataggatttgttaatgaatactttatttttcagagtaattaagagtacatgctctggtattggacttcctgagttcaaattctggctccagcattaccgaactgggaaatctctgtaagcctgtttcactccctgaaaggaaaataatacttcacataatggttataacaattaaataagaaaatacacataagtgggaaaatctacataaaggcattcattccaatgccaatcacattgtaagatttcaataaatattaactacgtaaaatacatgataataaaaatcaatgctttatcatctaatagacacagattttaattctaaatttatccataggaaaacatttagaaataaagcccacacatataattggtttttatacatgatttgtgccaactaaataagtcacatctttccaatgctgggcctggtgtttcagtttacctttatcttggagaaggattataataaagaacatgatatcccttattctttgaacaaatatgtacaatggtttaacaagcatctattgacaacaaaagaagagaaaatgaacttgagcaataacaaaaaggaattacattaattcttaagaatacttttttgaaaagagaaagatctattaagtcttagaaaaatttatttaggattgcctttctttggagatctttagaggcagggaaaatgcttttcaaggatgattttccaagttttatcgcttctctctatgactttcatgctacttaaacctatattatttttcctttttcctattgatttatattccagcatgtggacattcttttgacatagatattgatcaagaataagtattttcagacccaaatgatgcttctcttgatcaatgctaacactcattcttataatagaaccactgtaaaagaattgagtgtttctgacatgaacaagtgggttttagccctggtatattgtctcttgaatctgacatcagccaccacaaagttgaagaatgaggggcagtctaagtctgggcaaggatttcaatgagacataatcttataactgaatcaggtgacttggtgatgaaaaggttcaggaagatgtaaaaaaaatagaagtagggataattccctgggcaaaatttcttaaggttagccatgcatctctcataaaaaaaagtatctccaccagaatcaatgctttatatgctttacactggcaagaaccttgctcaccacagcgcagcaccaagatcagtggctggcacagagtagatgctcaataaatatttgtttatagttgaacaaaattcttccttcacctttttaaacctagtttctagattataggcttttgtaaataacaatatttagacctataattaaaatacagcagaatatggtattgcggaccaatctcataaactaattactattttgccctatttctctagaaaaaagcataaacttatgtgcatatccagttcataattgacaagttggcccatgcattgggaaatttcatcttcacacacattttgtggggtataaattccttttagaacgaagaatgcctgagttaaaactctccagaggtttatacacaaaaatatacactgtgcttctcctcaacatagttcttgtaggtaagaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaagaaaacaacaacagtgaatgtagttgtaagtgcgctaattctattccaataaacacaggccctggtagagttccttgtaataaaataccaggagtaggtggccagtatataggagttatctggtaaatgagatgaattattctcagtgaagaagaaagtggagtgacctcagactccactttaatggtggctcttttctagaggtgagggtacttgcctgaggtcacactgctattgttcagagggagtcaacagtggacaagatggaatctgaatgtttgcctccagagcctgaaatggactgtttaatttattggttttctttgtatggacagtttttatgatggttaattttcctaaagcaataaaaaaccataggacttctatgcttcctcaacctgatgtttcaagagctggttatccagttggtggattatccaaactgcatgaatcccctttctttccctggctgcctgcctttactgctcaactgcacatccacctaagagcctgcaaacgaaacaggaaaaggtggcatttaagacagccaatgctgatgatgtttttagcaactgcaatgagaacatttttccaagtagacttgttcctgagaagttgtataagtttgttctgtaattttaatataatttgataaaaacaatgtgttataagatttatatttacatatattcaaacagtctcaggtttacattcctgcattgctacttaactacttttactgccttggccaagttgcttattcttactgaaataatttccctctttatcaaatgagattatgaaaacttattttgcaatgttatttaagcacataagtacttgatcctgggtacctaaataaagggtagtcattactgttgctattatgatcttaactgtgtaaggtcttaagggttaagatcttaaatgggtaagaggggagtgttcattatttaaattagtaagtgactactattgaaagcaaagatgcattctgtaaagtaatcacactcaaatcttgatgttgacaaaaatacttctcaaatttcgtaattttatctcatctctctggaactctacattttgactttatctgctaaacaaatagtatttttaaagtaatattttttattttaaatttattaaaggcatataaatgacagaatgagacagtctgtataatgatattaaattgatggaattatagctggatgcaaatacttgttttatttagcttatactgggtggactaaatatatggccttttctaggtttgctaaaatattgaacacatgtaactgttgttcatttctaactaaaagggccctaaaaagtatagagaccccaggttgagaactgttatttttcaattataactgctaagcagtagggtatttctttttaatctattctttaattatttctttggaaagtcccacatgattcagatgtcagatgggttgtgccttttgccaggggttgcttagttaactgtttatttaatgaatggggttttatgtgctactgaatttctcatggcacacgttagaaaatttttggcagcatttaaattggagaactgagaaacatattggctctacggaagctcaatcagctcccaggcaggtgcagagtttttgccaacaaaaattcagtaaaataaaaaatgcaaagcccaaattctcacacaacccaaagaaaactgactttggtgtccaagattaaatgaatgctagatccaggcagctcaggtagctcaagaatggaaggggaaaatgcgtcataactttaggagagaagcaggaatgggaccttcttgttttggtggatgacagtatgcatacatttttggattgctgagaaaattcaactaactcctaaaaaaaaaagaaaagaaagaaaatagtctcatgtaatttcgcacgtcttttccttatgaagatgtgttaataaattaccaaaagatataatcggtttattcacttcaataaaaaaaaaatcattgaatatttttaaatgaccatagcagtcactgagcatcctagaccaagtatccagatggctatgttttttaaatgatttggccagatatatagacattgtataagcattggttaccagatttatttactctgactgggaaccaaaaaatatcctgacatgtcttctgagttctgaaaagtcctaaatgcacatatatataaaattttactcagtagtacaataggatgagaaaaaacaatggaaaatatttttttttaattaaacactagtttgagaaaataaagatgagaatgtatctttcagcaattaaagtgaatagtaccagcctacttatcattactacatgactctccaaactgtgtggaataaaagccatttgcagtcatctcctcccaagtataactgtcatcaactcctcccgtcaatactctgcccttggccagaccatgtcccagcccttctccctgtctggaagggcaatgtcccgagtcaggcttgttcttgatttctcctctcctagatgtagtttctggcaatactggcttattgaagactcctgcattcttgggacaccagtggatattctttagtatcattttcctgctgtattcagaaatggggagggctgtgctcattagcacagcgatgctgacccgacactaggttggccacctcttggtggctacataaacacacgttcctcacttcaggcctagccaacttggctgtcttctatttcggttgtatgttgaacaagtccccagtagacagttcattagagttggccagctacatccactttgcccctaattgcctttgattagcttctacgttgcctggtataattatttttttttaattgagatggagtctcactctgcacccaggctggagtacagtggcatgatctcagctcactgcaacctccgctgcctgggttcaagagattctcatgcctcagcctcccaagtagctgcaactacaggcacgtgccaccacgcccagctatttttttttttttttttgtatttttaatagatacagggtttcgctatgttggccaggctggtctgaaatgcatgacctctggtgatccgcctgcctcagcctcccaaagtgttgggattacaggcgtgagccaccgtgcccagccatcatgttaatatgaatcattacagcacccaacagcaactgtcaagcaccttctctgtgtcccatgcttgttgaacaacaaacttctacgtctcatgacagtcttatgaagtagacatttttatctccatactaaagctcagagaatttaagtattttgtccaaattacacagtaactaggtgactgagcagggatccaactcagcttttatctagcttgattccaaaatcacagatgcgattctagtgcatgctccccaccccatgggatagtagctgagttcctatttacttattcagccctggttctgggcacactttctcaatctcatcatcatgcctttcgtgtatagaagtaaagggactccttatcccttttctctttttcgaccaagtgcctcattaactagctgtggttctcttaacactgctggtaaaaaataatattaataataataatcccccttaggtttcatcctactctctttctctcttgatgtcaggataattgtttttctcctttctgtcctatgcactctgatttagtgtcacacttgttttgtgctcacttcactcttaggaccaaattaccagactacattttaagaaggtacaaacgttgttttgaatgttaagaattctttaagattttctaagttgccttgtaactggagaataaagaatgaggtttaacactaggatgaataacattcaacacatcagttttcaggggtctagagttagatttgatgattacagcctcctgtagtcaataagagaagagagatgtactaaccacacgtagactgggaccatttttttcattgtaactgatgaagcccaaaacagcagggccagaacttgggtgaggggtcaggtaagtgagatactcactttggaacaaaatataaaggaggatgttaaatctcatatcacgacaaatatttcaatgaaatatttttaaaacttaataagaaaaagtccacaatgaacaaggtattcaaattttaaataaagatatagaatctgatttttccttttgcctcaagctccacaatgctttggtagagccctgcaatacaatattattctaagattaatgaactccatttaatacgttggaaacatatttattaaaacaagtgcaagtaactagaatagtgtgggggtaaatttcatcattagatatcattaaaattagaactagaatgcactactaatttttaaggtgtaattagtcattaaaatcacttttattcaaaaataatgacgaacacagagtgtttagtcagacattcttttaaccactttactcatataatcctcatgacaacctgctgatatagtagaaaaggcccactgctacagaattcccaatgtaatattcattaaaatacaatgtctgtggagctgtgcagcacagtgcctctcataaaattagggtccccatttttcagaagaaactgagctcacatagtaagtaccagaatgaaatttagacccagacagtccagatacagagtgcttgttcctaaccatattatagaaacaaaccaagcctctcaaagatcaagtaatgtagcctatttctacctcaacctctgtgtcactagacctcaaattgcaattaacttttaataataatgatcctaagaaactctccaggacactggactagacaaagatttcttgaataataccccataaacgtaggcaaccaaagcaaaaatggacaaatgggatcacattaagttacaaagcttctgcacagcaaaggaaacaataaacaaagtgaagagacaacccacagaatgggagacgatatctgcaaactatccatctgacaagggattaataccagaacatgcagaagtccaaacaactaaataggaaaaagtctaataatctgattttaaaatgggcaaaagatctgaaaagacatttctcaaaaaaggcatacaaatgtcaaagaggtatatgacaagctgctcaacatcactgatcatcagagcaatgcaaatcaaaactgcaatgagatatcaactcattccagttaaaatgccttttatccaaacacaagcaataacaagtgatggtgagaatgtggtgaaaagggaaacccttgtacactgtttgtgggaatgtaaattagtacaaccactacagagaacagtttggagtttcctcaaaaaaactaaaaatagaactaccatatgatccagcaacccactagtatatatatacctcaaagaaaggaaatcaatatatcaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtggggatggttaatgggaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgtatcaaaatatcttatgtactccataaacacttagtatgtactcagaaaaattaaaaataaaagaaaataatgaccccaagagtagattctgccataaattttacagaaaccagtcaaaatttgttatatatattatatgtaatataaacacatatgtatgtgtgtataatacatatataatacatatgatgactcgccattgaaataaccttgagagtcactcatactaacttaagaactgcaatccatctctgatattcacccgtctacaggccaaatacagaaactagactaaatacctaaggtatttttataaaattgtgatggatactaattctgcagctcacaggcattgaaaggccaattgaattcagacccctggccctgtcattaacttctgcaggtgtataactggtattcttgtatcagacagccaatgtcatcaaaatggaatacaacaaattgttatataaaacattttagctctccacattaagtagcattataattatatgatgaaaccagagcactgtgaaggattataaaaaagattaaagaattcagaataaacacttgagaccttgtctaatacggatgctctcaagtaactactgttgccaattaacgctgctcatatacatgtggatttctgattatctggtttactactaaattaaagagcaaaaaataaaaaataaaatctctaatgcctctactgtagaatatttctattgatattttggagggatctataagaagccaatatcaaagcaggaatgtcttttagaaacaagatagatcaagcttgtctcttgagaacatgttattctagagaggaagaaggagtaagacatgggctggcagcagagtactgggggcggggggaagaatcaaagacagagaaatccagtggaagtaaagtatacgaggcctttatgctacacaaaatggtgggcatttccatagcactggtacacaggttggtgctgttaatcataccttattaattgctattagtaatctcatttagaattaatttcttataagtatcgtaaatccaataatctgctccttcctccttatgctaacatatcacaagagaaaaattttaccctttgtgaatttagaggtgttttcatgactagatgacttattcaagttagcactttgtgtgaatctttgctttgctgtgtggttgagtggcagaaagcaactgtaagcccaggagctatgttgacatgtgtctcactggtcaaataaggaattagatatgaatgtgtataaattatattaaacccatccagactggaggaaaacaacctatttgataacaaatttataacatggcagtcatgttatatatatataacatagcaatgctcatataatcctgagtcttgttaaaataaagactcaaagtgctgctacagactgtaggatatgatttattttgatatcaaagtgttttccgcagcttggttacctttgtgatttggatcagggaaaggtgtgtaccctatcaccttaccctatgctagatagatgtaaattttccacagaaagaagtggtttgggtagtcactcagttactagattcagctgtttttgaccaagccacaagaaataactcagtaaacaaaaactctttgagaagcaggtctaagtttaaatcccaaatcagaatgcctacactggaggaaaaaatcagtttttactggccatggctttagctataggcccaaggatctgtttcttggagagtctagttgataccaggaaggagatagtagttaaaattaatgcaatataaaatgtttcccacagtgatgcttaagtgaacacaagaacaaccctaatagctgattgcttcagaaaagtaaaatataaatggtcattcagaacaacaggtttgcacaggagaagaaactcagtaagtcacgagtttgaagaattgtattaagtttcctgggtcttaagaagaagtggcttctacattcttagacacaatgaggatgaaaagtttgaggttaaacctgtgtattttcattctctgtcaccttaattactcaaggtctcagtgtatttttgtctagtgtactatctctgtccttgttgtttcttgattctcctacccactgaatctatggctgagcacatttgataagtgtgtagttctgttcagtttcggatctgctaagatatttttaaagtacatagtgagatcataaaatgagatttttttttttggtttgaaaaattttgggggacaaataatatttaaaaactgtcaatgtttccacatttcaacattagatgggaggtgcctaggaaccatagagtatattgcagaaaagcaaataactaaaatgcctcaagggaagttcctgcaacacagagaaaagaaaaccattcagatgcttgggggaaaagcttagaaaaagggaaaaacaaaaagaggcagctggggtggccttcctccccaacagagctgaacctaagaacatccagataaaaccagagtcagaaaatactggtgttggttccacattcatggggaactctgaaagcctctcagagtaatctcgatttttggcagggtactctatcagtcaaggcctaggagtagatgtggtaattgcagaagggagttatattagagaagccccaaagactctggcgggttgcagagaagtcctttgtattttcaggtggacccagagaaaacaggaggactaaggggtcagcagaggtctggagctcacgcaaggagtcttccagaatcttgagcctgaaggcaaccacaaaaccccatgtcctgaagggcatgcacatactgtgcccaaacaaccagccaggtcattttctaatgcttaaaacatgaggtcaataccagacaggtgataaatatgatgctataccaaattctgctgccagaaatcctctccaatgcgctctggataaaaagatatattaataattatactgttttgttttttaatgtctgatctagctccttctgtttttgcaagcatacttcttagtggtttctttcataagaatagacttatttagcccatctaatatatgaatgatttcaaagttaatgttaacaataatagccatcactgattatttccaatatgtaccagtcagtatgcattgcagccattatcattaattgttatatcaattctctgatgtaggctttttctatccccattttcagatatcaaaagttaggtaactttcctgaagctgcacagctagtaataactcattccactgtatcacaccaaattacaacaaatgatttctaacaagtgataaaccctgacaacctctgagaacgaaaaggccagagaattagaagttaataaaacttactttatttttccctattcaacatttgtattcaagattatttattttcttagtggtcaaaacctactaggtactagaatgagggtcaaggtattgagacattttgtttctagtttcagctctttcattaattgtgtgaatttgagcaagtatctttattgctttttcatctgttcagtcaggataacaactgcctcattttactctcagtattatatgtatttctagccttgtcttaattgaaatacaattggataatatgcaatgtacttttacggtgagttaaaaatgcattattatattcacatataaaattatatcagtccaggcatggtggctcatacctgtaatcctagtactttgggaggttggggcaggaggattgcttgagctcaggagttcgagaccagcctaggcaacatagcaaaacctcatctctattaaaaaaatagttggacatggtgatgtgcatctgcagtcccagctactcaggaggctgaggcagaaggatcgcttgagcttgtggggttaaggctgcaatgaaccgtaactgcaccactgcactccagcctgggtgacagagagacactctgtctttaaaaaaaaaaaacggaatctaaagtcaaacacatggatctctgcctaggtctcagatgaaggacctggatgggaaaacatctcatttctaagtctatgtgggagtggtaacttttaaattaatttataagaaatataaatgtattagaaggtataaggttaactattagatagttaattattagaacatttcagatgctaacaatcaaatatgatatttttatccatattacaaccaagttaaggtaagaaatgaaacagcatctcattggggtggaatcccaaagagatgtaaacctgagtagtttcaaaatatgtgatggagaatttgaaaatctgcgcttatagattctgccaacagcggatggaagatatttgaaaataataataataataataataaatacaataataaaatgatacaaataaacaatgcactgtaacaactatttacatggtatttacattgtattaggtattataagtaatctagagatgatttaaagtatacaagagaatgtgcctaggttatatgaaaatactacacctatttaacataagggacctgagtaactacaaattttgccatgtggatgaggaggggtcatggaaccaatccccctcagatggttatatcatataacaaacatatgtcttgttatttgtgttgttgcatatttaagaagtctccaacagtttttcccaggactgggttttaaaaggccttaatctactgataaaagctttgtgcttaccctaaaaagtagtcctcctttacttcttttctagcatgtcaagaaagaaacacccaggaagacattagacaccctatgcatataaaaatggcaataaaagaaagccccaaatgccatctaaccaatagaagtagaataaattggtgggcattttacattcacttaaatatccaaatgatttaagaggatgtcgctaaaaattggctgatatattggcttttgtaaaaaaaaaaaatctgaattgaaatttggatatgaaccaaaagcttccgtcttcaaggacttttcaatttcctccagtttgcacgtttggaaactgaacggttcagcatatctctaataaaaaaatcatctcccaaggctcctttcctatgcaggcaaaatcaaattaacttcaaacagaagaggtgagatgcatacatagaggaagtatcaaactctaacatcactttgctccagctctctaaggtctcctaacgtctacctaggagagaaatccaaatgttaacttcacccaagatcactctgaaaaatctaaagagaagtgtggcttccaaaagagaatcatactaaattaattattcccctatgctgtcaggatttgcattgacaacaccatacggtagtattctggacttttacttaagaagtgatgacagccaacaagattccaggctccattcaaaggctacaaattgtgcggcacccttgccttgctagctgggcagccatttgaatcaggggattcttgtgctttggctgcagaagttgaaatgatgctctgtatcgtttgagacatgaactgctgcgtgcacaccacacaacgtcccccagcaatgatgcattgcactaatatgctctcagagcatactcactgggatgtattagagcaatgtatcaccaaaacacttaacttacaggatgtattgccacgtgaggtggaaatggttgccaatgaggtgttttaaagataatttctaaagttgtgtattaaatgatgtttatgtcacctttctggtgatttggaagataacattttgagattctgttatgcttgatctttggtattcagtgccttttccccctcacaaaagcactcttattgcagatcatttttaatcggaaaactcagtaattgagcttcacctaagtgtgacacaaaatgaatgaagtttgtgtgcattgctgtgcaatcagccctgaaattcagttgtgggcataagccctggtgctgggctgcatcttccccagggtgggcgacatatgggctagcagtaggccctgggcagaaaacatgagagccaggtagggatgctccctagaggcagaaagctctctctgcaggcacctacttcctctgttccaatcccgcataccgtttaatgacaggctctgtattgctatagttatgtgtgccaaagaattctgatctctctttttattgcctaattttattagataaaaggatggagtaacattagaaaactagcaatttacaaattctaaaaatagatattagagtttctcttattatatatatttttcagattggctaaaatatgttgctggatacccatttcataaggacagagtccacatctgttttgcttaccatttttccccagtacaccatgtctgacttgtagaaagtgttcaataaatgtttattcaatgcattaatagtcatgcttcccttttacagtagagctatttcatcacaactttttctttggaggcaaagcatgacttctttcaagcagaattgccctctctcgtaaccagaaatcaaattgcatctaataatgttacatcatggcagttacttttgaaagagttgttctaacctctagaccttgcttaaagccaacctaggatctttataaatatttatttataaaaacatgtgaaaaagacagcagggagggggagaaagaaagaaacaatgtgattattactagtatttaccagtgcatttaaacttcactagattcatttgaaaatatgtttccatacacatattttcagaaaagtctttattttgtaaagagatatccacacatatgcacatagttaaagctgcagcagtgactacaaatagatcagaaaaaatcatatatggcttatacaattagtgttctcatgtcataatcatattttgtatactgcagttttttagttatggtagtgacaaatttcctggtatatttcctcctcagtaatagattttttttggcatttttgacagtgtcatatattctagtgtccaatataaaacaaaacaaaaccctataattcctttttatagttgcatttcaaactaataccagtgcattcctgattctcttcctattaaatcatgtttttactcttttttccccctcatttcattgtacatcataggtctccaaaatagctttgattttaagctacctaaagaaaaacatttttttacttgtaaattcaatagcctctctttcattaattaccagacacacacaaacacatacatacccctcttgaaaatgcttccagttctcttttatacattctatataaaatagatgtaagacttgcattgccaaggctgaatttgttcgtatccagctgggtcagggtataatatgatggcagctccttttttaaagcattgtcaatttatatttctcctaaaagatggctttcctgacctcccttttaactttctcattctcatccctctggctttttccctctttacctattctcttcccccaacctcctctgtggttaagtagctcttctttggggctttaattagtaaatactgcacctctatgatgtaatttattatattcttgctaatcttttctgacattttaatgataagctcctggtcatcagcagccatattctcatccaaaacttgtatctatattcccactatggcaagtgatagactgctactatttggttgtgaattttctgaaccattattacgttttcaaatctcagcattttttcacctaaagatgattcttggtgagacgcttcacatgcagaaatcaatgaataagtaatgtaagctgagagacaactctgaaactattatggggacgtaaaagattaaattagaacattcattttttgtcctgttactggcacaaataaaatatttgaaatccaaaagaaaatgttgttaatctgtaaatataaaataagtctcatcaactgtaatagataaatgttagctgcatatacactagttgtctaaaaaaaaaaaacaaagattactggcaaaagtatctaattctatgtctcattagacctttatgattgatttcccgcagtatcactgcacggcagcattccatattttagttcctaagatcacattatatatggaattccagtttttctttgtttcacttatgtgtttagctgaagaacattactaagtactttttcaacctgcggccaaggttaacaccgtgtaaaaatgccaataaaggagaatatactccattatatctattgttatgatcaacaacttgggacatatataaagaaaattctgccataatacatttagtcacggtaatagtacctgactgaaacacacacacacacacacacacacacacacactaaatggtatgtcttttgaaaggaaataactaaattaaagtcatagcaatccagaatagtgatatatgtgttgggaagcccaagtttttaggagatggaataaattgttaaaacagttactaaccaataattttagctataatatgcaataatgtcatctaattatctttttgttggagcacttgtgcatagatagatactataaagtctgacgtgagttccttaaattatatttaaatgtagattaaaagctaggaaaattgacattcagatttagcaaagaaagaatagtattttcctactataatgttacaaaaccattaaagactacaatttggtactgctcattccacaacaagttgttgcagaatattatgaggacacaacggccctgaaaatcttcatttccaatattaaatccaatgctctagactttcttgtgctttttgtttttagagcccttgaacaaaactaaacaaactttcaatttctcttaaatcactctttttgatttgttcatagcaagagcatagtgtcttggactccggaaaggctcagttccagaaagtccacataggaagggttaataaaacaacgtttgataggggtacttaggaggattcttttgaagctgcatttgtacagcaagcccataactttttaaaaaatttgttttgaggtcatgggagattcatatagaattgtaataaatagtgcagagagatcctgtgtgatcattactcactttccctgaatggtaacgtctttcaaaactatagtacaatatcacaaccagggtatttacataaacacagtctacctatcttaattcagatcctttacttttatactcatgtgaatgtgtgtagctgtgcatgtgtgtatttaatttcatatcattttatcacatgtataggcttgtatatccaccatcaccatccctcatttttaacagtgtatgttataataaattaaaaaaaatgctaaagctttttaatttatattctagatctagatagataaaaagctaaagctttttaatttatattctagatctagatctagacaggcatgagatataaatcattcatattattattattttgattggggtcactggaaaggcattgatgagaatattacatgaacgaaatccacgcctccccctacaacttgctctcaacactgagggcatctggggttagacttcaattagataccatgtaaccatcacttcttacctgcagcacacatttcattttcagatttattttcccttaagctgcatttcctattttgacatgcttctctacagaaatcatccaagatattaatattttcttaagtcatatgatcctaatcttaatgtcataaaccccatccacaaactgtgggtagagcgaaatgaggcgtcttgttttgcaccagtttttaaagcagagcaagtgctttttgggctacaggaccaggaggaaaactgattattagctattgttttctgatactaagtctaggatgggattgattacattttgtacttttattctagaggtgatgtgactaaataggaaagcctgtattagactcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatacaaaaataaaaaaatatatatattttggagtgtgagtgtagaggaagtgagttgggagttcactgtataatgaatacagcaagattcacaaggttgcattattgtcatccagctttttcataaatatgcatgtaatatgaaggtgaatctagtaggagaatatgacaatcctaccactggaaaaagcaattgaacatcaggtgcatccttgtccgagatctacataagaaagatggcaatgtcactaaagttatcatgaaagggttatattttctgatgggggattcttcagaagaatgttttcaagcagcaaggagatttttctgattgaaattatttatttgctttatttcccttcttgcacaatcttttcccatgaggtttgagaacaggtcttattcttctttatatttccctcagattttagactggctagttacatgaaataactattcaataaatatttacagaattatatcatgcctaaatttcatatttcctgaagaaaatgcacacccatattttaaaagaaaacagaagttggaaaacagacctgcaaattataaactcagaaatcgatgtcatccaatgtatgatgctgggtctattttttaattttagctccgttgtttattgcaagcatccatccttcctataaatccccacacctacatccataaacaaagctagctgaaacccacagcgatctgggtttcaacgtgtttcaaaataaaatcatttaaaaatgatcagacattaattcaacacattggtgttaattaactaaggtctgaaaatgtctataattatttttagttgttacttgattaacatagagaagtatatcactattattttctctagaaataaaactgagtgggacagattatgagacacttctgactcacctagttctccaaaagatgctggaacagagagctacgtatgaacaagaaatgtgtcaagtgaaggaaggttggaagaaagtagaggggtatatgctggacaaaagactactcaacccagtagtcaacacattctagatatctgaaaactgagttttccctctcctttgtggcagtctggttcaagagggtattgttctctctccactgcttgtctcctcataaatcatctgagcagaagggcttatttccatgctatgttcacagctactataccgtctagaacactactgggtctaaatacatactaatgaaaataatggagagaaattaaatataagttgctatagtcccaaaagaactcttagaatatggccatacacatgagtaaattaccttaatcgaaggtaatataaccttgaaaatgtaacaattcctttaaaagtattaaaaaatacttttttggaggacaatatactatgctgagacaaatcaacagaattatgagttttggatttgacattcagcattctcatttacatttgacacctataaaacagaaatatataaatttatgaatacacagaagttccctaaggacagtgatttttgtctatctgctgtatttcttgaattctattgtctggcactcaaacatatatgctgaatggatttataattaaaaataaaaatgtttggctagtgaaaatatcctttcttggcctacagttttcaggttaatgtggcagcacctcgtatctatgcatgccaaaaccctaataatgataatccaaataataacactcatattgctattcccactttattggatagcttatgtttctctcttcaaataattaaaactcaaataaattaaactggccatatttcaccatccctcagattcataggtaatataaaggataaatcagtagcccagtaagagacaactaaaaggttgaatttattattctttgcaaccaataagtatgggctgagttcttaaacaagagttttctgtgataatttttattaggtgcaaagggaactaatgaggagaaataggtttaaattgaaggtgagaatttggagggatcatgagaaagaatgtcatgatgatgacagaatggtactagcaagagtctttggagtcttttgagagtgtcaaggacagagtgggcagctacctgttctggacaataagacatctagctagaaatgatggagccaaaccaggttatctttaagagctcaaataaagtaactgatttatccaagagcatacagttacttagaggcagatccaagactatatgccatgtatataaactaggtgcgcttggaaccatgggctaggtcatggtggagagtgacatcttaaaaatgttaaaaaagctatgccgtatacatagtaatatttcactctagtacatcatcacagagagaatatggcttttctgacataaatagtcataaattagtgaaatctgtttgagaacatacaagccccctgttcgcaccaatttagttttgttaataaccgggaagatttggttgatcttcagaaagttttcttagctgcaggattagcaaaaggattcctcgctataaattgcagctttgatttgaaatattagtttaatagatggctaacatctttcagatcctaaaaataagtaataaaaaattactttgcagggcacaagggctcacgcttataatcccagcactttgagaggtggaggactgctagagctcaggagttcaaaaccagcctgggcagcatgccaaatcctctcacctgtggtcccagctacttggcaggctgatgtgggaggttcgcttgagccagggaggcagaggttgcagtgagccgcgactgtgccactgcacaccagcctgggtaagagtgagactcgtctccaaaaaaaaaaaaaaaaaaaaaaaaaattatttaccaggtgaaagaaagaaaacagaagagaataaaacaaaaatagcaaagaggaaacaactacgaacagagacaggggaagccactagcaaaactagcacataaacataggctacgtagcatctctgttctttattaaccacactttgggatctgccagaaaaaaaaaaaaaatcaaagtaccttatatatttaggtttgtgtttatttctaaaatacttatatgacaaaagtactacctcatatcaaaatattaaaacagctttgatggcttccagttcccccgctgaaccatatggtttcagttgggtttcagttgcccatcaacccccgcaatagctatcagaaccagtcccacgtaccttacttcacagctgtcactcacttgcaaaaattctaatgtctaatcacagtacacttgggttatttccctaaggaacccacactttgtatatattgtctctctccctctctttcttctctcttttctctctgatcccattattcattctattcattcaatactttcacctcccacctagttttttttttttcttttagagacaagttctgccgctgttacccaggctgcaattcagcggcatgatctcagctcactgcagcctcaaactcctaggttcaagcaagcctcccatttcagcctcccaagtagctgggactacagacacctggctaattttgtttttaattttagtagagacaagttctcactatgttgcctaggctggtctcaaacttgtgagctcaagagatcctcttgcctcagcctcccaaactgctggaattacaggtgtgagccaccacacctagcgcctctaccttttaacctgattaacctactcacctttcagaactcaggtacatcaaagctaaaaaccgttccctaaaatcctcctctgggattcttacagcaccaagggtgtactcctatcatagaatgacaatgaactgttgcatttgtctccatacctgccagtttccacaaggaatgttacatttactgaggttagagactacatcatgttaatttttgtatcttactgcctagcacaacactcgatatataggggtactcatctaatgtttgaagactgagtaaatagccaagatttattgagcaccttctgtacccgaagtggtacaggcattgtactaaggatattatattcaaggttcacagaatctatcaattccttctcccaatctagaattttctttgaagaccccgaccagatgtcctagccctcaccatcttccaactatcaataattagttagccatgcctctggcacatgcaaaaagtaagatgatgatacacaaaatattaacataaaattattacaagtatctcttccactgtatcatgtgcttaaaatccctgatttctattcctcaccttgaccccaagtgactagtgatgagctggacatttggttggagcccaataaatgtttgttgaatcacaaccatggaattgacaagagtctagtgatctttttcctcttctaaccatacagaaagaaaaagtctacccagtatactgcattaatacgtccttgaaaaattctgatttctagtttgggcctcaggatacttttgaaggagagtgaagaggttatgtctttgaattaggagagaaataatttcaccataaatccccaaagataatgggttcaaaggtatgttgccctaagaaagttattttatttttgtttgaggcaagccgaaaactatcccttcaactcaatatgctaaaaagatatccttcaactcaatatgctaagttgtttgtgtggccatatgttcctatatttctaggtcagtcttgatcaaatacttttcttccatgcaccccataaatacacttgtactcatcagcccatctgtcctgctttccttggcttggaaactgtggtcattgaaaaagttctatttattccctaccaaccatctatctttttttatgtttaacaattttaaaattatttacactccctttctgaacaaaaggaataaatgggcagctattggcaaagaagataaatatgatgagctattctatgttgacatcaaatgacttagcaaagtgcaagtggtggagcaaagaagagcaggttttctcctcatagtttaagggttctgttaccttaggttggtaaaccaaaatgaactggtcttggaatgttcaaggtcagtattgatgctgccactatagtttggtatgctggtttaaaatgctgcaaccacagtatatctacatgaatgtgatggaaatatgagagttcacagtatatctatatgaatgtgatggaaatatgagaatctcagccccatgtagaaatgagaaggtaaatgtatcccatacacaaaataaaatagatgaataattctgggatgttctcgagtgtggcatatagtcactgacatggtcactgcagtttgatgctgtttctcaaacttgagtcgtgcacacaaagttttttttcataaaaataaaagttttaggtccctaagaataaatttacatacctcaccctcttcccacagatcctgagcattctgatttgaaaaataatgtagtagtagtttagcccatgaattctagtatcagatctggattcggtgttcggtgtgcttagtaaccgcaaaacgttaggcaagttaacctttctaaacctcagtttcttcacatgtaagaccgggacaaaaaaaccactacccttaagtaaaataagccagacacaaaaatacaaatattgtatgattccacctatatgcagtatctaaagtagtcaactccagagaaacagaaagtagaatgatggttaccaggggcttgtgggagaagaatatgtggtgttgtttaatgggtgtagattatcagttttgcaagatgaaaaagttttggatatctgttgctcaacaatgtgaatatacttaacgctaatgaattatatactaaaaaatggtcaagatagtaaattttatgtaatttgttttttatgattaaaaataatacatgcccaacaggattacaagaaaactaaattttaaaatatgaatataaagtactttacctaatacttggcaaagtcaatgcactttataaatagaggctattgaaaataaagcaatcaaaattttcaaaagtaataagcacacagaaatttctactgattccagtaaacaattttcattccctagtcactatttttaattggtttttgatggggcctcagtcaagaagagcagtgtactcattcagatgattcattcatattgccaacttcagtgattgccatgaaccctgttctttcagtgaagcagtaagtggtaacttgagaagtgccagcctcctaagaggggtcactgagttacatttggtcacatctactcaggcattctggtaggcaacaaccatttcaaaaaacctactgagcagagccacacagattttctttcttctggagaaaatgggctggtgacatgtctgttatttgaagcaagaagccaaagtccttctcaaattgactcccactcttacctcgctgatacatcctttctcacttaatttgctccatctacattagcctttttcagtatgtctgaaatgccccaaacctacttaccctccagggtgtttgcacttgctgttctttctacccagaacgttcttcctcaatatagccaaagggatcaccctcataccttcttcaagtttttgctcacatgccactttttcagtgtagctctctgtgaacatcttataaaaataattgccaccatcttcttcttctggcccagggacatgtacttaattatttccacagtaataacagccacagataaattatatattttaaaaatttatctagtgtctgtctccttccagtatagtacaagctctataaaggtaggagtcattttcccttttgttccctattgtataccgacctataatagtgtctggtataaagtatgcacatattaaattttttaatgagtgaatgtattggtgcaagccttattcaatatattaaaaaaaaaagtagactaatcaaaagtattctccccacaaaagaaacatctaagaaaaattagtggcttcacaagcatacccttattaagttattttccattaaactcaagcccttttccagttcagtgagaggtcttctgtttctctaccattaccctaagtggaaggggttggaaaacatagaagctaacacctcaacagttgttgaaaccaatttgggaatgtagaggtacaggtagataaatgtagttaataatgtattcatttacaataatacaaatttcctgttatagtaattagctttatgaaaatattccttagattcctggtttatgctagaaaataaaatgtctataaatattattatatttgccattggtgtcaatacatggcttctgttttgtattaggaaagataatttccaaagaaagaaaatactagaaagaattcacaacagtgagacacaaatcctgagttccaatgcaatcttgtctctacccagctccctgaccttgggcgagacacaatcttttggtgtgtctggctgtaacagttgggttttgctgcaaacctacttaactccagtgagcctcgatttcctcattggtgaagcgagcataagaatccctgttttggccaggcatggtggctcacacctgtaatcccaactctttgggaggctgatgtgggcagatcacttgagaacaggagtttgagaccaacctgggcaacatggtgaaacaccgtctccactaaaaatacaaaaattagccaggcatggtggtgtacacctgtggtcctagctactcaggaggctgaggagggaggctcacttgagcccaggatggggaggttgcagtgagccatgttcaggtcactgcactatagcctgggtgacaaagcaagaccctgtcttaaaaaaagaatccctgttttccctattgcagaaagttgccttgtaactgaaaaccaagactcataccatcggtgatatgctaggtgaagttaagtggttcaaaaactgtatttaatttctgaattatagttatttggatgtgtacttggagggaaaaaagtataactagcatattaaaattgtaaatatatgaataatatttaggatgagattaatttcaaaagtaaattgtttaaatgtaaaatattaattaaatgataagatagagaatacatatatatgtctcaattatgaaagtgatatacatataaatggggtttgtgaaaaaaagcttgaagaatcaatgttgatggtttgtgaattttctttccaaagttaacagtacaagccagggtaagatggtatttatatattaagacaaatgcaaacaaaataagatgaaaataaatgtaaataatatgaagtattatgattattttagtaagaaatgatcttctttgtgagtgcctattatattctaggcactcaataagactaggcattttatctgttagctaaatgcttgctagcaaactgactgcaattgagttagagcaagttgattgtttcctacatcatacatccaggccataaatccagttttgctgattctagcctatgttctaggagagttaaaattttagaaacagcatccagaattcaataaatatatgtttttaaaaaaccaaaaggcaaattccgcaaatgaataagctgctttttttaacatgctcctgatggctccctatggcaatactgtggaaaaatagaatctgagccttatgaacaggaaataataaaaaataacattaaactaaatagtaactgtgacactgggtctttgacagagctcaaagattctgcacctcatgaaatcatatattttaatgggaagtgtgtagaacatatacagtgtgtataaacattgtgacagtataggaagtaactaacaggaactctagagtgctgaatgtctgactcctccgacttcatccattactgaaaaatttgtaatggtaaaaacgtgccttcagtaagttatagtatttctgttctagtctgttcttgtctatttattggctttttggagtttacctagttacctattttctctgagtcttaattttctcagattaattagaaattagttatatttcatcattagatatctaatgatgagtttgctagtacaatgccggttagactacccacagtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactggaactgcaaatgcctatgatttgcctgaaaatagaagggagggatctaactattgtctgtttcctaggcacgtgcaccctcattagactgtaagcaccacatgaagtcagaaaccattaggttttattcactattatatccttaatacctggaatacagcagatttttcataagtatctgaatgaatgtatacacaaatgaatagaatgtatttatggaacacctgtcatgtgacaataactgtgtaaggttcattgctcaagtatgaagcatagtaaaataaatgaagacaatatgtaagttttaaaacaccttgtaaatgtaaaatgctacaaaagcatttttagagttttaaaaaatcatttacttacatgcagttttaaatcacagccctcaaataagttccaagtcagagattttatcaagattgtatttacttttttaaaaaatggagttttatgctgctgtggttatggaatgtgcttgtacaatatatatatacatatacatactgtttgatgtagctctatacaatgctgcttctttataatattgcttatgaactattttgtttaatgccactgcgtctatgaaacattatagactattctgttagtatgcacagcttttcccatgaccttaatacctttatatacctaagcaatgagagtgtgggagaatgtattgcattcccctggacaactaacattaactcactgttacagacctaatatgtgtgccccctctccacccatattcagatattgaaatcctaactcccagtgtgatggggcctttaggaagtgatgagctcatgagggtgaagactcatgaatgtgattagttacttccctcataaaagagagcccagagagctcccttacttctgctatgtgaggatacagcaagaagatggacgatcatgaatcagaaaatgggccctcaccagacactgaatcttccagagccttcatcttggagttcccagactctagaactgtgagaaaccaatatttgttgtttgagctgcccagtctatggtatttttgttatagcagtcagaatggactaagatctcaacatactctaaatactctcagcaattggctcaccatactctaaataatataactccctgccctgattgaaaatgttatgttccaaacacagtctcccccactgaggtctctgtcttttattaagtgttttaacgtagtggttgacaaaatatatacaaataatattgatcaacatgctgcaaagaaaaaagaaagtgcccacagcactccaggggttcaactaacaaaccagtggggagatgaaatagaatagagctggttctttgaggtcagggactgaggcttattcaacattttatctgagcttgttgtttattcaacattttatccgaacttggtttctagcatgtagtaaaatgtctgatgactcgacaaaggaaaaaaaaaaatagatacctaacataagaagagctattagtataaagactctgaagctgactgcctcttcataattaggacagtcaaggaaaattctaccatacactatatatcagatagatagatagatagatagatagatagatagatagatagatagatagatagatagatgtatactagtcaggcctttaaaaaaggacagataatgacctacagaaaggaaaaagtaagccaaacaatgatagtgatgtaaaaaaatgtgggtcccaggaagttctgagttatctatttttatttatcataatgcctatgatttccttcttctttgaagtttcctcacatcttattccagttctcttctctgctattgtgattctgtccggtttcagtggctcttcccaagggggctgacgacagcgaggcctctgtgctgtgctggggaggagggtgacccctatctgggacagcacatggttctcttccctcagtggatgctgccaaagccgagcagggaaatgcgccccagtgtgcatgctaaatacaagttaggcgcccttcagcgaagatttcggcttggcttccttcccttggctattaagctacattcccacaaaattactacatgtctgaggtttctaaaaccttttgtgtggatctcaaacagttactgtgttggatccaaatttcgaccttggttaagcaagcctcaaatccgttccaagctgctccaggcagtgatgctccaaggacacccgatgcaaggaggagataagaataacctctacagcttggtgatcacctactgtgtgtcagtcatcgtgcttcactctttgcatgcggcatctcatttaatcctcactataaactgtgcttgctagctactacgactactctaattaccactaatttacagatggcgaaatgacagtttaaggaaattaagaaacttgttcaagttttacaaccaataattattaaaggattaaaagtattgaaaccctagcagtagacttccacagttggcaagggccagggcaaatgacaccagagtgatctaaacagcctgagtaataataaaagccatcaatccagcacataaactgcctgcactctgtgcatcccaaaagacaaagagaaaagtagtaggccatgtttctttatgcatctaggtggcaagtctatgagctgagagacagtccctctgtgaggagaaacagaagttcacaaaacagagggcagggaggttctcttagcttgtggcaggcaatgagtcaggagaggtaacttttggaacagagcttgctcttggcttagggagtaaaaagtgaaaagacttccaaggactaacaggttctctccttacacagggtaatgaaggctatcacactcagggcttagactttgttgatttatagactttgtaatctattgcagtgagcttgactgttttgattctttttttgatacaggtatctagttcaggggaaaagatgctcagagttagaacccttgtgtatagtttgagtatgtggttagcgaaagcctagagaaaaaaattttgggaaaacaattttgtccaagtgcagagaacaaaacttgcattacagcaccagcagcagaaagcttgtcataaagatggggaagtggagcagtttcccagagcactttatttaggaaggcctcgtagccaaatggaccataatcaaggtggtgatcaataattactactctaaaaagcccctggcataggccaaatgaacctctctttcctctcccttcaccttgatgctctgctctcaatcactacaaaatgaaattctcccagatcagagtctgtagtttttgtgaacaaagtcattgatctctgatcgtgtgttattttttgtgaaacttataaacttaagcatgattaggtgaatgaatactgtggcgggataaataaggttacccaatcttatgtaaatgcacaagaatatgtttggagcatattttcttcattccagtcagcccagctccacctcagtacttctgcattgacaaatgaattgaaaatgaacacatggagtctgtcatctagtcccagcagggaactagtatgatatacttaaagggcactgaatttacaagcatgtatatttctctcatatttttctatctttagaataatataaactgtgaggtataaaaatatggtaattcaacttgtctctttgatactatcaattttaaaagccatcaaataagaagatttagatgaagaaaaggaaaacactttatgaatcaaatagactgaaatgcaatattatatttggggttctatctgatccctgcagttagtgttcttacagagtagattttgtggattaattgtgtgatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttctccttcctgctgccatgcaaatgaagaaagacttatttgcttcgccttccaccatgattgtaagtttcctgaagtctctccagccatgctgaactgtgagtcaattaaacctctttccttcataaattacccagcctcgggcagttctttagagcagtgtaagaacagactattacagatataatttactacatatcacaactatagatattcccatacggaaaatgtatatttgcatttttaaatgtatgctcgcatttccttggttttgtggttcatatttggtagtgaggtatatcagtcatatggtcatatttatgtaaactgaaacctaattcatatgtttctaagttcctgtgccctaaaaaaatcaacatgcacatcagcactgtcggggaacctttaacacctgtaggcgtaagtatgggtgagtcatagaggaagtcatttgctccagattattaaacatggaagaaagacctcctgataactttattacacatgataacgtgtgctaggctaagagagagtcattaaaccaaaaagcaaagccttctaataaagagctgaagctgaagggaaggactaagaaatgtctctttctaaggcccatagaaatagtataaatgtgttgtgtgctacctaatcattgaagaaataagatacatttaaattttagttattgattctattcacgctaacagcattttgaatcctataaagagaggacaatcctggggacttccttgttttccctttttgccatctttcaccacagcgtgtttttacctcttgtcttactccatcctatctcaacaccaggggtgactctcatactgctcagggctaatcactccacgatgctttaaatccaactcatttattcattattcatattgtgtcttttgtccacggtaccctctgagcactgagaggaattctaaaatgaataagagttgacctctcttcttaaaaaaaaaaaaaaacaagcaaaacaatagtgaaacaccagagcggagatcttatctgcacatccagattgggaaagctggtatgttggggtgcacaaacatggggtgtgtattgttatgaggacatgtggccacctggaataaaatagtaaggagggcttttgaaatgatggtgagacctcagtgtgctgagtataagacactcgcccaagaaagaggagtttttcttaggctgtgacctgatttgacagaaaacatattctgggttttggaagaaagaaagaatttgttctctggttattattattatttagatatgagatgccttgatgttatgcaatttttctctgtactacttttttgcaagaagtggggcatgctccaaatcccttgattatgatttatgggccagggtaaaaaaaggaaaaaaaaaaaaaatacccacctctcctcctactccagtttgacccttcccctctacctttgctccaggtgagagaagcactaaatcacagataagagccagagtaacatttatagcattgcaaagatgccacggtcagcatttgaggctatgagtgtggcaagtcctcccggacagatagacctgagattaatagaaacggatcaaagacaagtacccaggaagaatgattccaggaagattggaagggctgcctcagaaaatgcatatcacttgtaattctgccatagaaagggagaatttgaaggcataagtctctcaggtgttttttgactaaagtcaattatgactttagtttctactgccattattatctatgttccttaataattctccaccagttctgctgtagcaaggagaagtgagaaccaaaatgctaaaacaatgcaaaaaataagcaaaagctttaatgtaagaataaacactgtgttatagaggctcttatctttccatcagtttcaacttctctctcctaatggcttcccaacaatgtcttggttatttcctctaagaacactaactttgcataagcatatatattcctagctagagtagactggtttcatgtttgttttgatggcactgttatgatcaggcatcagaagcttctcctcagccttttacttcttccagcaacagtccttctctctctttttgctcatggccaactttctaagaaaaacaaccaaataaaaatacattgcttctttctcttcttcacccactcttcataacctcttacaatctgagttctttggataaatatttttttcaaagatgcttccactaccttccactaccttttctcagatcgttgtcctttctcagatcttctcttttataatagttgtctacatcattcacgatctatcccatgttattaaaaattgctgtgttttggagcatcttctatgtggttctttgttgatgtacaccatttcaaaatgccaaaataaccctttgttatcctactcccctttcacagataaatcacattaaaagaaattatgcaatttgccaaaactgctggacttacgtttggaatagaaatgtctaattccagatctctgactctctccactattccactgtgtctagacagtgatactgtgtagttcacagtaattttattacaactactagaagaaagggctcagccaggtcaaaactacgaaaagctttgtatatagcagaacagatggtgaggtttgcccgttctcccttggagaagggacccatctgtctatctggcttgacagccttcaggagccccacctgacatggacattcagtagggatttccctagtctgcctggaaaataaaatctatttggattgctcctcaggtgcctatgaggaacgtgggaaaattcctaggactttttttttttttttttttttttgacccagtctcgctctgttacccaggctggattactgtggcacgatcacagtgcggtataacctctgctcctggactcaagcaatcctcctgagtagctgggacaacaggcacacgccaccatccagttaatatttttgtattttttgtagggatggggtttcaccaggctgatctctaactcctgggctcaagctatctgcctgcctcagcactcccaaagtgctaggatttcaggaacgagtcaccgtgcccggtgggacatgcttcttaatgaacaaagtcatatggagggtcttgtcttgaggagggacatggctctgtcttaggctttagttgggtctctgttatagctagctcagaagagactgaccctctagccatatcacaataccccaaacctttgaatgatgtgtcagcagggatacagtctctcttatctactactacagcagcctgaggatctactttcaaggttctatctcaccctctccagccataaggccccctctcaagctgtttcctcttgtgttaactgtcattcagctagtgccctaccctgggatacattcctttcctctgatctcttctcttccctgtcttatcttcataccttcattctctaaagtgggtgcatctcaatgtcctgatggttctggttttctcccacgtctcctcattaaacttcccagaatgagcatggcatatccaaatgttcaacacctcctccatgtgaatggctcctcatctctcttctgagaacctgttctgcattcctctttaactgcatgtttctgaagcactgcaaaaataggttttcttgtttgctgctcggcagccaacacacattcagaatgctgctcagtgttcaataaatgtttgttaagcaaataaatgagtgagtctaaaaaaatgatttgagtctccccctgtctgtcttcattaccttttctgataaaatgcccattcccagcggggcacagtggctcacggctgtaatcccagcactttgggaagctgaggcaggccaattacctgaggtcaggagttcaagactggcctggccaatatggtgaaacgtcatctttaccaaaaatacaaaaattacccgggcatggtggcaggcacctgtaatcccagctactcgggaggctgaggcaggagaattgcttgaacccgggaggaggaggttgcagtgagccaagatgtgccattgcactccagcctgggcaacagggcaaaactgcgtctcaaagaaaaaaaaaaaaatcccaaaagcctcaatacctctacccggtgaatttacagaacaaataaatgaatgagtccaaatcaaaactaaattttgcctgcccttatccagtactcttcctgccactgcactgacatcacagcacagaggagggaaacagcccttagaatcacattgatttagtttgcatctttgttcagtctcttaacaggatgcagccttggaaaagttacttagcttccttgagcctcctctataaaaaattaaaaaaataaaaaataaaataaaataaacttttttaaatcagaaataattactcttcaagtttaaagactaaatagcatgtgtaaaatgccccaaagccatttatacacatacttataagctgtaatcctaactctcctatatatgtgtgtatatatatatgtgtgtgtgtgtgtgtatatatatgtatatatgcgcgtgtatatatacatatatatacatgtatatatgtatatatgtgtgtgtatctatatacatatatattcatatatatgtgtatgtatatacatatctatatatatatacatatatatgtatatatacacatatatatgtatatatatatattttatttttgttttgtttcgttttttgagacagagtctctctgtgttgcccaggctggagtgcagtgctgtgatcttggctcactgcaacctccgcctcccaggttcaagtgattctcctgcctcagctgcccaagtagctgggattacaagtgcccgccaccacacttggctaattttgttttgttttgttttgtacttttagcagagacagggtttcaccatgttggccaggctgctctcgaactcctgacctaaagtgatccactcgcctcagcctcccaaagtgctaggattacaggtgtgagccaccatgtctggccaactctcctatttcttttaaagatacatcaactacctcatttaacactcacaaaaaccgtatctgtagatacttttatgtctccaccttacagatgaggaatcagagggactgagaaaatgacttatttgcccaaggtcacaccaaaataaaatcctaggcagtattactacagagttcatgtaagaaatattcttagattgcaagctcactaagaaagccttataaaaattcagcccttacaaaaatgggcaagccacaccgctccaaataaattgtgcctttagaaggtggtcactacttactgaagtaataaagaaatatgtttacctgttgaaatctgacttctcggttcaatgctcaactattttagaagaaaatttgtatctctaacaatgccaaatgcagaataaatattcttgccttgaaaattatgatataataaagaaaacatacttgggaatgtttttccaaagacataatgagtattgcatgaaagaggacttttaagttaaagtgagaaacagaaataattcaagggaaacatgctttactgaaaattatataagtcaatatcccagaaaccaagtaacaatttattcgtcagaataaggaatacatgatcaggaaatttgtctggctaattgaagttgaagaggttgcacttgatgaaaaggaaatcatcagaaacgcctggatgtttcctataagaagctaaaatatgcattataattccagctgtggatagaaatttaatgcatttttacaaggtacaaagggtgaataattgttttgtcagttgatggggtggattttagttattttaataactataacctaattgaaggaaagcagaatggcatatcagaaaatgggggatacaaaaccaaatggtggaaagcaaattgattgcttatattagaaattaattatatattaaactacccagagttctagataaaattaggaacaaaaataatattttagaagagatgtgtctgactagccaaaagcaaggagaaatgcagaatgtcactgaaaatctaaaaataaaagcctgaggtaaagtgattatttcctcaaagaataaggatgcacataatgtatcataatttcttaattagagttctatgacaattgtagttacatccttccagggatagatatattatgacttgcaaagtttgctaatggctgaaaataaacaaaaaaaaatagaaaaatttctaggtaaaagtagttaagactagctttttttttttttttttttttgagacagagtctcactctgttacccaggctggagtgcagtggtgccatcttggctcactgcaacctccacctcccgggttcaagtaattctcctgcctcagcttcccgagtagctgggattacaggcgtgtgccaccatgtccggctaatttttgtgtttttaatagagacggggtttcaccatgttgaccaggctggtctcaaattcctgacctcaagtgatccacctgcctcagcctcccaaagtgctgggattacaggcataagccatcacgcccagccaagtcttgctttttgggggcaaggaatagtaataaatgtaaaagacctgttttatggaccctggaacagctcatgactttacttagaagtttctacagaaataactaaagaatgacatttctccaaaaccagttgaagaactttttagttagatgatgacagacaagaaagtcaaggttaatttgagatatgctggtagaatcctaagatcattaaagctctggtatgaataagaaaagagaaaatgacatgaaggattctgacatttagaaaactagcaatgggaaaatgcctttcacattctaagtttatttgtgaattaaaaaaaaatgaaaaaagaagtattgggttatgttgtagatgcttctaccaatatggttattattttattaagttgaagatcttagtgaattcatcaaggatacctgactgatgagacatcttggcaaaaaaaaaataataataatttggaagaagtcacttaatctcactgtgccttaatttattcacctatttaactacagggtttatttccctaaacagtatgatatatactctttatattttttctagtgttaacattttaagcttatggaaaaacatgactacctacgagaaaaataaaagtaaattaaatcagtgtgttgtgaagatcccatgtgtttcagcattcatcagactgaaggcagtctccaaaacatccaaacagggtttttgagaatttaactcttggatctgttcttcaagtagtataatacgtggtttgacatgcatgctagacacctgtttttcaggatggtaccaaaacaacagaaattctgatgaattatgtcattcgagttatcacaattgattattcaaataactctccgtaattatgatcttgacttctacaatgtaattataagaaagtcagttgttcaaagatatccaaaatgttcacccttggcaagcgatggatgggaagagtggtgacaagaatctgaaatttgaaattaacctgatgtatttgtaagtttttcctaacaatgttgccgtccattaaggactgtttttagtggactttcttaagcttgtatagagttgacctgaaggatttaaaaaccatttcagtttattcagtgtttgccatgtatgccatacacatcatacactggagtacatttaaatatcattaaaatgtaccactgcataagacaggtctgctccttccttgttctaaggtaattctgtttcatgggttagtcagacacaaaccggtgttatcacacagaactgtcacgtatttgatctgcaatgttcaccggttacatggagctaagaaatatacagaagctaatagagttataaagagtctggaccaagaatcataagacccagttatgagttgttaaaagtgagggtgaaacatgtcccttcagttttctcattttaaataagactaaatgatctcatcttttttattttctttaaaattttaaggccttatgcaaaaggctgaaaatctaaatggctaagatttaatggaatccataggatttcaatgagatttggaaaattcatcaactatgtggcacagaaaatacagacagcacacatgtactatattctgtatgggatatcaggaccaaaacaaaacaaaaaaaatcaccatccaggttgataaatggaaaaaagagggtagagatctcttcctgatacatcctcagagaagattttggcctccctaaaaattccactgaaagttaggtgtctctaatgttcatttttcttttttttttctctcaagcttcatagagatcctctatatttaagtttcagttttgtttatctttaaagatctcttcactgttcagaatttcttttccagaatcaacaatcactttccaaaaattgctcttatttttaaattttgtacattattttttccatcaagaaagatgattatcaaaaggaagtttccttccttccttccttcctttttctctccctttctgccccctttgctcccttcttcccttcctttcttttaaaattactgatggctcagatacactttctattcttcatagaataaaagggaacatgtattctggcaaaaaaggaaacagactttactgacccagaaaagaaagcatgttttgaatctcatccatctcttccactggcattttaatgtcctcccataattacacactgcttgcttagcatgtgtgatcataggaccaactacagggatggcttctcactctttgatttatattctttaatggactccagccctggggccagcagagctagaacagaagacgcagtctgcccctgatatttcctggtctttgccaagagtttgcagtcaaaaactctcctagaaatcatttcctagagataatcattcttaacatctatcctctggaagagatctctcacctgttcacaagcaccatacctctcagagaatcaaacaattatttaaaaatggactatgaggcaactgcacacagagcttatccatctacctttgctagaatacagagaggcatggagcagtggaagcatatccagtattttgaatttttaaaaacatcatgtgttttgatcatataccctatgactggactatgggaccagcttcaggtttaaagcagtgaagctgtttgatggaaacctgtaaaacttaatgagaatgctgagctctagcatcaaagccgttggctggctcagaaaggctgtggggacgtgggcagaggcagacttttacatcttgtgctgcttcttgataatctgattcttggatgctttgcccaactttacttaaaaggggaaaaagaaagaaagaaaaactaagcaggcagataggaatctctttcaacacacttttttcttaaatttgaagaggatttggtttgttagtttgcttttgatcaaggagatggtagtggtagaaaattcttgtctctcttacctttttggaataactaaggtcacttagtgtgatatgctgggacccctttggctagatgacttttcagtaagaactttaagaaatttatataaaaatgttttctgtgtttgcaaccacagaacttaaatattattgtagagagggaccttaaggtacacagagattaatgctttcacttgaaagatgaaaaccctagtgctcatagaagttgaataaaatgcattgcgttgcactccacatagactggtcaaccttgatcactgggtagtctaaacgattaaagactgcatctcatgaagccagttttgttagttccttcatgcttccgaccactcaagctccccactccttttcactttaatctgaagcatatctggtttgattgctttgtttgggcagaaatatgtaaattttgcttgtgtttgtattttgtattcttctttctccaaaactgtaaaaagtcaccttaattctacctttgaagaatctctacactgtatctcccactggatctgtttcagtatatttacatggaggcttaggctcttttgatcatttattcctataaaatgctgattctatgcagagttttctagaaatatccatggcagtgaataataaacagcagccttgattagggtgaagttgtttcccttgcatcatttgcttctgtatcaccttatatttctgttaaaaatgcgggtctactgttgaatcagaagcaagggggacatgaagctgcagtttaataagctctcagatgatgcttatgcacaaaactctgaaccactgacctacagggtaaaacccaattcctttcctgcagcagtcacatcctgtcattactttatccatttcaacatcatttatccaaacttttatccagcacaattattgacctcttttccccatgcatcttttctccagacacactaattccagatataccctaaacacatcatttattattttacacctgcaccttttctccaacttttcctgtctcgactcttatctctatttttgtttacttggtgacatactacttttcgttcagtgccatactacttttctcaaatgttacctccttgggaaagccttttcctaaatatttctcagtcaccatccctatactgcgttgcaatagaatgtagcataaatctctcttatagaacctgtttcatttgaatgtaattacaatgaatctacacaaaggttatagaatacctactatgccccaaattataccattaaagaaataaaagtcacaatctctaccatcacaaaaattactatccagcttttttcaacccaaatcctcatctgaaacagagaaaacagaaaggtatttgagtatttcctcaattctcccaaggaggatacataactagcaccattacatacaacagatgtcttagggctttagggtttcatctacttgggaaaccccagttgatcaaatactggtaaaattacattacagtagcaataaatgctatgatagagataattcaaaggtgagatgaaaaagcagaaatatctaattgagtatgtgtttatctctcctcaaccatgtcttaatcctgtttctatgcttatttagcatctagatcagtgccaattatgttgtggtcattgaatacattttattattgaattaaaggcattgtaattcatttttattagtgtgactctttggaatctggccgaggcaatgtgaattatccatatttgtaaatccagcatctagtcagtgcttaagatactgttggcactcagtgagggcttgtagaataaatgaacacatttggaggagttgccctattctccagtagaaactcaatagcaatgacaacaataacccaattaaaaatgggctacggacttgaataaacatttcttcaaagaagaaatacaaatggccaacaggtatgtaaaaagatacccaacgtcagtaatcaccagagaaatgcaaattaaaactacagtgagatatcacctcatgcctgttaggctggctattattaaaaaagacaaaaaagaaaaaaacaacaactgttggagaggatgtggataaactggaagctgtgtacactgttagtgaacatgcaaaatggtgcagctgctctagaaaacagtatggaagttcctcaagaaaataaaaatagaattattatatcatgcagcaatcccacttctgaatattcagccaaaaaaaaaatgaagtcagaatttttaagagatatttgtactcctatgatcactgtagtagtcttcacaatagccaggatgagcacacaacctaaatatccattgatggatgactggattttttaaaatgtggtatatacatacaagggaaaattattccgccttaaaaaagagaatcagccaggagcctgtaatcctagcactttgggaggccaaggcaggcagatcgcttgaagtcaggagttcaagaccagcctggtcaacatggtgaaaccccatctctaccaaaaaatacaaaaattagccaggcatggtggcataggcctataatcccagctacctggcaggctgaggcagaagaatggttgaacccgggaggtggagggtgcagtgagctaagattacgccactgcactcctgcctggccaacagagtgagactctgtttcagaaaaaaaaaaaaaaaaaaaaagaaggaaatcctgcaatatatgtcaacaagaatgagcctgaggacattatgccaagtgaataagccagtcacagaaagataaatactgcatgattccacttacaagaaatatctaaaacagtctatgtcatagaagcaaagaatagaattgtggttgccagggcctggggcaagggagaaatggggagttgccaatcaataattataaaatttcattatgcaagaagaataaattctagagatctgctgtataacattgtgcctctacataacaatactatattgcacatttacatatttgctaagtgggtagatcctatgtgagctgctcatacaataataataataataataataataaaataaaacttctttcatatattagaatatattcatttggctagatgacatagttatcttttcccaagccacccatcaattttacagtcagttcttccctctcagtaagattgaaaattaaagaataataaagttttagaattgaaaaaagtgatagttttaatttgaggatcagaagtaatacttaaagaaaaactactaggaatgcaaaattcttcctttgtggttaatctacatttataactattccacttgacatttaattgcttcgcgtgttatgtgtatttcaaagacaaaaagaaagagtttattaagactgcaaatgaagtgaaaaaatgctgcatttttctgggtggacagtaggggtggtggtggtattttcagtgttattgtcatctaacgaagcctaatttagtttgaatatatattttggaacaaatagcctccaaacacaaattcagtttaggggaagatagtgtgaaaagggataaaatgccataaaattctgatgtcctaaagaaaatgtgagagtctgggacacctccttgttctctgcaaagcctgccgccagctcacttcagacaaagttgtctttttataaacatgatgtaagcatacactcacaagctctctggaaataatgatgtttctacttgtgtcagttaaaggcatccctttgttcatctaatcaccaagaaaatttcaaggcaggtgtgcttcagtttagagaggtgccgtacttcatgggtgcctctaagggactctttacaaaattcatgctgcagaagcagcattcccctaaatggttgcttaagactgcaaatccccaactgtccaatttatatccaaggaagagtttactttctttagggcataagccattatattacaaagtcattaaaatggaaataaatacataagttagcaaattgtggtaaggtaaaataatcttatataaaccatggcctaaaaataaagaatatatacagaattcagcatgaggatattaccatacagaaatgataattaaccaaagtaaacctgcacacagtgattttctgcattttggcaagtgaaaaatttttgctatgaaagcaggactctaaaaatcaaaaaaaaaaaaaaagtaaaggagacctagttttgaattgatattaaaacacacaggcattttactttaatggtcatgggcttaggtccaactatttcagaatccaaagcttattacttagatagtcaacgcacatcattccaagactgcagctgctcctaatttggattgttaggggattatccctataagagtcctcatggctcatctgccctcagtgtaatcagatgagaagatcctgacttccatctccagaaagaaggccaagcccacctggggcctgggggtaaatgagaagcccacatgggtaaatgagagcttctgtgggatcttgacaccgagatgctgagactccaactgtaagcctcagagtcactactgagctacaaatcagcagttttacatttattatttctaaaatctggatttgagttgcaatcaaggtatatcctgatttagattaattggcagtgtttcgtgatccataaaataattgtgcaccaatactgccaatgatgacaatataatatggtggttgacgtactctagctcagtgattttcaaactttaatatgtatattaaatcacttggggatcttactaaaatgtagactctttcagtagatcatgggaaggggcatgagtcttttcatctttaacaagctcttaggtgatgcacatgctgctggttcacatccacagcttgtttagtaaatctctaggtatgctatgagttgttcatgggctttatttccttttaaactacctaaaaactacagcttttagttacatgtccttgtttaaaaattgttcctatatcttctatgtagctttatatgcacatattgttaaacagataataaaccaaataattattaaataataactaaaggtaatgttaatgaaagattggtttcaatccttgatgatcacaccttatagcctggataccttggggaagaaaatgttactgaataaggtcaatttactctttcaaacaaacatttcagacgctcatatgagactctgcttggtttacaggtagtgaacacaggcagggaagactaattgcttctgaaaaataatgcgaaatgaaatctgatgatgacaatgataacattcttaagaactaaaataattacttgtatttgaactataaaaattaactgactattcccaattcagttcctttacaaggtacccatatttaaaaaaaaatccagtttcttatttatctctaccaatttttgatacattagatagtggatgtcatcatttaggatagcaaaatggaaagcacactgggcttggagtcaataaacagaggtttccttctgacttttttcacatattagggatatggctctgataatattatgtatgatttgtggtctccaagttaattcaattttctcacaaagctcttagaacaattaaatgaaacaacttttaatatgagacaatgtgtgcaaaatctcataaattcatctgcaaccaggacaattcacatatttgtaggggtcagtgtaaaatgaaaatgagaagccctctgttcaaaagttattaagaatttcaagatgacaagaagaagatattaaatgaagagcagggcccttctatgtgtggagccccatgtgactgcataggttataagtccatgagaaggccctgtctgcaagataattgtagctaatcctcactatattaatagagtattaataaagtttatacttgattgagatattacaatataccaggcactactctcagagcctcaattacatagtctcacttaatcctttacaggggaaagaaactgaagcacagaaacatcaactatcttacctcaggtgatacaactaccaagtttaagggagccaagattggaatctgggagtgtctgattctaaagccattcatcttaactaatttaatgcaatgagttatctataaaaagttattgttattcctgtttaattcaaatttagaaacctaggctcacaaaaatacgtccatatttcaagggcaattcacttactatgaccttgattaaatgacctatgtcaacctaattgtcttatatccctagtactccacagagagcctggtacatagtccattgtcatgtactatatataaaactaaacactcagtcaccaatttttctgtgcacagaatatttactccacaaagataaaaatctcattttcctattattcaaaatcacatgcttcggaataagagtattattttcatttaaaagcaattaatttgttttaaatgtgtttcaagagtgatgattttcctggggaaaaaaagacaccaattaacatgcacagaaataatttccttccaaacataaggactttgatccaaagatctaaagacaagagtatatcatctcataatagaaattaagaggaactccaaaatactcattttgttttggatgaacttcagatttttaaaaaatatggctcaaacttagttaagtaacaaacttaaatttatatgaaggtgtttttctttttcttagcaatgtgttttctgatccttcatctcattttatctttcctattcttttccaattgtgatagtggaactaattcactgagcttcagtcccatacaatatcatgcccagtatacaactgagcagagagacaaactcagattacttgattaccttgtctttgaaattattactaatgtcctctgcaaagctaattacagcttccattgtattattagagaaatttttcatacctcacttaggaagcttgtattgtaaatctatacttatttgcccaactctctctccagattcctgagtgcattatcttactcatctatgtgccccagtgtctagcacagagcctggcacatactataaatagatacatatatatatatatatatatatatatatatatatatctgtacaaaacagaatagccagatcacttagcccatatactatagtcattactagaacatagcttgtaattatatttatatatatatatatatgtatatatatacacacacacatacatttatatatattttttgagacagtctcgctttgtcatccacgctggagtgtaattgcacgatttcggctcactgcaacctctgcctcctaggtttaagcaagcacgtttcactaattttttgtatttttaatagagatgggatttcaccatgttggccaggctggtcttgaactcctgatttcaagtcatctacctgacttggcctcctgcagtgctgggactacaggcatgagccactccacacctggcccatactagatagttttaatgttgattaacataatgcacacatgcaagtgttaatgcataagcaaatggagcaatttaaacaagatgctctggtaggtgctgaaattaagagaaaatgttcagtctcagacattgttcattgctgctttctactgggctgaaaaatgtcatattctataaaatgtatcaagtcctcagaattaaaatgtcactgaaccccctgacagaccatgctatgctagcttgatatttgaaagcactacaattcattatgccaactgctgatactgttccaggctatggggcatctgctgaaaatgatgggaaataaaaatctgtgggtcccctggaaaggaaagattctatgtttgaaaagctgaattccagacaagaactcaccagatgctttgtggactgaagagctgggttccatttccttggggacctgagcagatgggactccctgaatccactttcaaagaggagtgtctatggcaaggtgcctggtttctgccccaattgtttatttcccttgcctccaaggctacaatgcacagaagtgaacttatccttagcaatgtatagagccaatactttagaaaatctaaaaatctagaaagtacttccaaatgtgttttctgtgcattcctgtttgtatggctggctacacagtatggaaaataaagcaagcattatcttagtttgccttaagaggaggaaaagtgtgcaggctgccagagtagggaagaggttcacagaggtaacagctccagaccaattcaacccggggagtgggaaagattccactgaaagctcatatataactaactgggcatctgagaaatatttcctgctgcttcttctccccaatcagatcttcccttctctgacatcccagcaatctaggctgcatttttctgttttcttttccctaaaggttcctacgaagctcatttcgtctaattttatctttataaaaatactgagaatgagagaagtgaagtgagattgtaatatgatacggggagcaacacagagtggcagttacgggcaaggatttcgctctcagattatttgggtgggagcttagttttgttacttactaattattttcccctaggtcagttacttcacttttcctatctccatgtcttcatttgccaaatagggatagtatttatgtgtacctcttttcatgcttagagtattacctttgcaattatgaagctctgagaaactggtggtgcatccctctctgcaatataataatcataatgtattcaaaaaagggctagtaaagacaaaataccagaaatccaccaaaaacttgttttttttcttcttcttccattactccctttctgataggtttgaaataccaagtatcaaattatttcacacagtttcatggatttgtttttgcaaagttgttgttttactgtgttcctgatgcccccaggcacatgcctcttgggtaactcactggatgttgttgaaattttatgagaaataaaaaatgcttaatatgttattattatgctttctctggaatatgctgactcccttaccccttcagcaaaagctcctacttttcatgtacatttgtatagagcctagtacaatcataggcacattgaggcactacagtgtttatgccatgggggtttgtttgaatgatctgatgcaggtaaagtgctctactaacaggactatcaactcagggatggcactcacagccatgtgttctgttgaggtctcatgagttctcatttgcataagggaatgattattattaacctgcgtgcgttattgtgaagacttttaaaaggaaaggaggatttttgcagtctactattctacacatgaaaggaggcaagggtaatcgacctctgcatttaagtactgacactattacagtagaaggactgaaatacatttcaatatttccgagatctagaagaaactaggctgggcctataacaaactgggttaatgacacataagaatttgtcaaagcctttgacatttccacaaaccccatctagctttcttgttaaagttttcaaagcaaaactatcatcttccatgttttaaatcaggtagaaaaaaaatttctttctatacctgaacttctgccaaaaacattaagcccatttgcctattctagatgggctaaaccagcctctctctgagtcactaaaccaagaccttgcctctaggaatacagcacagagaagctagaaaattgtcattcagccccaagccatcatctctagtgctcactaggctgtacagaatagaacagtcagagcacttagctcaaatatatactattgttattattagaacatggctactttgtgagtcagcccattccagctgacacaacaaaatgacatactgtatagtgcatactgatcctacatgaaacacttttaatataaaagttagcctgtagccacagtcagtccactggtcaaaaattgagcatctgctgcgtatcagcctggccaatgcatgagtacttgagtgaagggacttctttgcattttctcataggctattaatcttgcgggcattagcaaaatctatcttaaaatgattcatacaggccaggtgtggtggctcacgcctgtaatcccagcactttgggaggcccaggtgggtggatcacaaggtcaggacatccagaccatactggctaacatggtgaaaccctgtctctactaaaaatacaaaaaattacccgggcatggtgacgggcacttgtagtcccagctactcgggaggctgaggcaggagaatggcgtgaacccaggtggcggagcttgcagtaagccaagatcatgccactgcactccagcctgggttcatataagtgaagatgtatcaccacataaaatcaaggtagtattatccatagttctataatgatatggtaagtaaaaatatgtggatctgtatggaaaatgtttaggaaaaagtgaagtgggaaagcaaaaagcaactgtcttcccgaaagagtgagggatgaggcatatgggaaggtcaatgtaagtaaattgtaaaatggtaccaaccagtatatggaccatgacaaaataataagagaagagaggcaataagtcagggacctcaacaaggaaaagtctagaggaaatgaaaacctggggataaattgtttaatcatgactttggaatccatgtgagttctctgccaactaaagtagccctccctcctctcatctggcatgatttccagacatcactgaagatctctttttcctccaagttcctgctaggttaatttatccatcaggtccaaagccttttatcccaaaattggaataaattggaatgcaaattctgccatgagattttgttcttacgtgtaaatgacagatactctattcctctctgagcaaacaggaaaataagcaaaaaaggggaggagcggggagggatagcattaggagatatacctaatgtaaatgacgagttaatgggtgcagcacaccaacatgacacatgtatacatatgtaacaaacctgcacgttgtacacacgtaccctagaacttaaagtataataaaaatatatatatatatatataaaataaaaaaaaaacagaatatccccttttggaagtagaagtagattaacctattaaactaatatcagccattcaaaaaaaaaaaaaaaaaaaaaacttgaggaaccaaatttgatgaggatggtcaaccacagaagtgcataaattgagaagccttcaaaactttctaaaactttctctgttgtccaaaagaagaaagatagggattaaggggcatttgcaggaaggaaatatttcatctctttcccagtgttgatgctggtacactgtgatgtgggcacttcatatggcagaggagatcacacagatttcattaaggaatcaatcattttttcctcaaggaaaggaatcaagcattttcaccaataaggtgagggaaaatgcttacaaaagataggatattttccaaacctcatctacctcagtagcatcttccagatttgtggcaataaatgtttctaagtgtaattaaaggctgagccgatctaattaggttgatgaaattttcagtgggacttcattccccttagcatttcactcattttttttctctctctctagaatacttccttaggcttaatctgagcaatttttagtggcagcattctaagttacctcacacaggcagtgtctccactctgattgtaaaacctccagcaggtacatatgactaaaaacaaacttcaaataaaggattctaggttgttttatttaacacacagtcctttcctacctcttcagtttcatttccttactaacaaactacgttaaataatgttcactctgcaggagggaaataagcatttcagagcatttcgggggcacaaagagaccaggaaatgcataataattgcaggaacaggttctgagggggagattaatgagggagcgccatgacccttcctgataggtcagtgactacagaaacacttatacgatgaaaatattgggatagaaacacatactagtgagattttcatctatctttaaagattcttaaaatatatctagtgagcacctgaagaattaactgtaagacttttctacaggaaaatgctttccaagtggtctaaggtaaatgggcaagatgtcctcatagagtctgagcatctcagacaccatgatttctctttctgcaagattttctaacctcctctccttttgtagcagtcactcaaaaactgcttgttagaaaatttaattaaatataaaatgatcgaaaattcttaagcaacatatatttcagctcttactcagtgttatcaaaatgcaaataatataaacaagtatttctgtcaaaacagtgttgcctttgcaaaaatcagatttagaaagcatatttttttaaagacctattatcttctaagaatttcataggtatgggctgcatataatggcaatttattatttataatttttctttaactcttttttttcaaatttaaacctgtgagtcatttttcaatgagtacagatattttcccagactttgatttacttgtgatgaaaatatgaattatttaaaaaaaactactttgatctctatttgaattcccggccattcaaagttccttgtcattttaaacaaagcaccatatgaagttcaggttaggttttaccaaattattttgagctaatcttattttattttgaaatttgataatcacatacacaaaagtaactttccaattgagggttagttgttctacgtgcaagcaaagtctcatttcaaatagacattattaaatgccatatagggaaagacctaagttgcttctaaggaatatgagattataggttgtttcaatatgttgagtgatttccttttttttctttaatctgtaaagaataaatgtgtaaattcgtgagagtgatatttttatgccttgaatgccattgtttacaatgaaatagaatcggccatttaaatattatattttccttgatagggttctgtattctaatcctgctggacccccttattactcttggtcaagtaacttctctaggtctgtttccccaaaggaagaaagttgaacttagaaaatgatttccaggatcctttccattctaacactccaaaatttcttccatgacttcagacaaggtgttattagaatctccttcaagactggttatgctaagaggcactacatactagactgaaaataaaaatgccatcagccaataaatgaagtcataattaagggtttacacatgcagtgtgctatcgaccaggaagtccaagctagagttcaggaaaatttacatagattttactgttaagagagattctgtgagaatgaacatgggtatatccctctcttttcagtaacttcacaaagctgacctatttgaagtagggtgatttaactcacaatccatgatactttgtcactatttcatttcagaagtaacaagagcagggccttctaaatagataatggttcagacaggatggaaactatcaacaactaaaaagccctccaaagtgctgggattacaggcatgaaccacgacacccagcacgttgggaggccaaggcgggcagatcacttgaggtcagtagttcaagaccaccctggccaacatagagtgaaacccgtcactactataaatacaaaaattagctgggtgtggtggtgcatgcctgtagtcccagctaacttgggaagctaaggcaggagaattgcttgaacccaggaggtggaggttgcagagagctgagatcatgccactacactcccctggggaacagagcaagactccatctcttaaaaaaaaaaaaagccctccaagtgaggtatgttttgatttatagattaattgtgctgatatccttccaaactccagtgcatcagaagaagtaaaatgaaaaagattacacaagtcaagaaaaaagtgaccgtgcttcctcagacacacaccccagatggggaagacagagttggaaagtgtccaatcaataaagaagagtgaattgtatccaaaccctatagtgacaacagcacaagtgaatcctccttttatgagtttagccactgtgaactaacatgtcacttggaagaccacctaacttattttttggtattgtggtttttctggttaaaaggccaatataaaaaaaaatgaatactaaggtaaggaatctttatttatcaattcataaattagaggtgttaatctgaagcacggtttaatttgaaactgttattttagattaaggcaattaactacagttttatacacacacagaaaaaaactgcctcacttatgcagaattatcagaagattatgtgtctcagctgaactcaaggattccctgcaggaattactattattattatttggatgcccaagagttctttagttagattcccatttctgctagagttccctcgattccccttcctttttccaatctaagcaggattactcttctctgtataaagcaggatgtagggactgattatacctggcctggctcacagtgaaaatgaggaagttggtacaggtgattggggatgcggctctgccctccactttccatccctagaatggagtttcagaaatcttctaaaaatatctaattattcttttaccatacctgatatgctttctccatccctgcctgtctaaattagtcactgtttgagatgctcatattctgactcttctgtgtttctctccttgtcttctagaactctcactcatctcaccctctttttaaatcaaataactgtgttaaataatttaataattcattcctcacagtctattattcatttgtaaacattgttttagtttgtaacaaatttgagagtttgtacaatcttttaggaactctaacaaacatttctcttgcaaaagggctcttaactatggtagttaagagcacaaggacactgaaatcagacttcctcgattaagatttagactttcatacttgttagttgtgtgaccttcctcaagaaacttacctgcctcaaacctcagtttctttgtctgaaacatgcagataataaaatgtctacctattttgtgaggattcctgtaaagctcttataatagcacaaaataacagctctggaaatattagtactataataataataataataaataataataataataattagattatcatcctctacagagcttaacacaaacctggatcatactacatatttgtaaccagtaaaagttactttctgaaaggcaatctatcactcctactacaaagcatgggtaggtttggcctttcagaactgcacctcttcatgtttgttaaaactattgcacctttaaatctcccttaggattattctatatacatccacatactgggcaacaaatcaaccagtatgttcacataaagagaagacagggaaggataattcagtagtaattgtttttccctaatgcttaactgaatcaagtttatatgattaaattatttacttcagaataaaccaagtacatcactgcttaccaacagcacctatggctaacagtgaattcaaagttatttaactttgatgtttagaaatctacaccattaaattgtaggcatacaatgtaagaggaacctctggttccagtagcccaaagaaattggattgtgtctgaatgaatttttttaaagacagcttttatggaaaatattcattaaaaaatgaaattcagggacttcttcatctttctctccccaaaacccaacaaattccaatcttatacaaagttacaatacacaactacagctgataatgagggatgaaattattgatgtcatttagtttgatgatcttgctcagataaatatcaagtaaattcaccagataacatttacttcctccagaatgtgttgaaaataagggaagaaaattatgtcattatatagacttattttgttttagttttgttttgaattacatagtcgttgcttctcctataggctaattgctttttcttcttttttcttttaatactcaaaaaagtcatcactgtatgcataacacctatggcatttaagtagaaataagcaagtaaaccatttagctcaactttagacccagtatctctttttgtttgactttcttttatagctaatatcaactgtccacacaaatctcaaatgtaaattacttacagactaataaagaagaggaacctaattccttcataatgatctatgagctgtttccctcccccaatcctacataaacaatagtagaatattgaatttaaagttgtgccgtttgactctggaacatcgggtcttcagcaaaggtgctttcatgctggatctgaaatgatgagaccatgaattaggaatgattctgatggcaacgatatttacctctttgagacagcccataaagttgttactgactggtgaccctggaaggtcggctgtgctgggactgcctccaacatagaaaaagtcatcagaccccagcatggtataatcttcttgcgtgtagcccgttgtggtaagaatcccatccactgatattgtcacctagataacaaagcacagggaaaggacacgctatactcagacctagatactgtaatcctgggatatgcctgttttgtgttttgcttttgtttttttgttttgttttgttttgcttttttctttttttctgtttgtttggtttttgtttttagacctatgacggaacccattttcatgtctgtttgaggtttattcttagattctattcaactagccctaagagatctaaactagttagagagttaactgattattgaactagtgtcagcatcatccctactgcaactcaaaagttattgagcagacacaaaaatggtgttagtaaaatgcttcctaggttagttttgctggtgtacatattagtaaggtttagttgtctgttattaactaatcacaacgtgcaccttgttaacataaaaggcgcaagctatttccagcaacatcactatttgcactattgagcagcaattgttcagcatgcaagtgcctaagtccatgccaaagggagagaaaaggcaaaacaaccagtagaagcggcacacgctgatgtgcacatgcaggaggtacagtacagttcagaaaaggaaagaaagaaaacagggagaaccaaaggaaaaacataaaaataaaaacaactgctttgtgatgacgtaaagatgagtgggtgtggcatctccagcattcccaaatcaagtttccatgccatgcatcatgaatggttagagactggctgagctgcggtcactcgggccagccaccattttgtcttatcccgtgttaaccacagctggatgcaaaacgttcgaaacgttaacgatgcccctacaggtgagttggaaaacagaagttgacaggaacaggtaaaaaataagaaggtcaacaacagatgaaaagaaggaggtcaaagtaagcagaagagtaccaaccgcagttcctcttttgttaatgatgtctacagttaaaagaaagaaagaaaacacacggcaaacccaaaataagaaacaattagaatgatatctaccgaacaatgtagtttgtttaccatagcgtgtccaatgcctgagtgctttgtggagaaggggggagaaaggaaattaaaaactgtgaacagaataacgatcgttacttaaaaaatatgatggtctctaccatgttagtacattttttgattcaggtaacggttagtagaatgaaacattccatgaatgacatgttagttattaagcatgttagtaacatagaaaaagggcaaaaaaattttacaagaaaaaagcagactaacaagtaggcctcccacagaggtaatatttttcctgctattattgttcataatttgctactagacagaaacagacacatgacaatgttccctttgtcttcctgagtacatctgagagacattggaaaagtctaaaagggattcaaaggcctaaagcgtttcagctgaccactgcagccctatgcccatacttgacccctcctccaccctggcccaccccagccccaggaaattagtaggaatcagttggcattgccctactactcaattttacagcatacaaggactcctcctcaacttcaaaacttccttcggtcatattgatggactttagggtcacagtttactgcaatgaaacaaagcaaagatcctgacacatagaatgagtagaatggatttgtgtttaatctgtcctgctacacatgcaccccggctgtataactacagtttcctttgagctaccaattcgcagtttggtttgtaacctgagcaaaggcaaatctagaaagtggactccttgagcccccacccttccttctgtgcttctctcaaatgagcctctggtttctttgtgcatatctgagagaaaaaattaaaaaaggaaaaccaaagagacagacttataggaaatccatggtctacagttatactgatggtggccaatcctctccaaaggcaggtggaagcatgcagggcccctcccatgtcaatgagggatctggaaggtctggggttctcaagaatctttcagttttatttgtttgccttagctagactaaatctacactcctaaagctcctttttctttctctagctcagatagtataaacctttcagaacaggaaagaaaaggttagacagttaacagctctgaaagagagggctgttttggtaaaggaaaaccagagacaatccggtcattctgcaactgttcagagaaacaacaaatatgttaaggatattagtttaagatcagcatgtacggcaataaaattagtcactgtcaacacttaacaaaatgatacactgtaatataaagtttcacataatacccaaaacttataatgttcaatataaaaggacaatctattcattttcattcgtatatatactgtaatcacgtattcattaaaaacatacagtatatgtagacccacagatttagtaaatagttgatattttcctagtatatagcatcttgaaaaagtttttttaaaaaaatacaattaaatagaaatgggcacctagaagattaactggcctttccagagtcatttggggtttaacttaaagcatctatgctaaaaataaaagtatcttcaaaaacagacccttcaggagatatgtaagcccctaaagaaatttttcccctcagggacttctcttgtccccattttggggttgggaggaggagggagtagggactgatacaatcccaaatcacaaacactattttttcgactacaaaaaaggaactgtgacttaatgaccccaatgtgcatgcttccaaatgatcaccatgaaaactacaatttaaaattaaacaaacaaaaaaaccaaaaacacaacaaaatcacacacatcacaggaagggcaggtcgcagggatatccttgcagcccttttggaaattttcatatggccctgtatcaaaatagcctttgggctcccagaactttctagatatgcccctgctcaagtatggcaggaagattcatctcagaagaagaaaaagctaatttgcaagtgactctgaggagccctgtatcatgttgttagagtatttaagtaccacacacacagctatagcgagaaacaaagccagttactctcttatccactgcgctgttacctgacgcagattcctggtgactttcacatcatgccaggcattatcattaaactttccattcacaggctccactagtgcttcaaaggcccctgatcccaaattaatgaccagagagacagctccatttttcagggcaagattgacataatcagccgatttcccagtgtgaagcatcagtccattcctctgaagggttttaaatgacagagttatttcatcactgctgctttgaatggggttttgagacaagtcgtagcagaagtattcagatcctttgaacgtggcaatatattcttcttttcctagaggaaaacagatgatacatacataagtaaacaaatacactatgcaaatcagcaggtcttaacagaaacaatagctaatcactccccaaattaacctgcttaattagatttcatgacatgaactctgtctcagtcaaacagtactgtacagggcagtattttttaaaaaattttattattattatactttaagttttagggtacatgtgcacaatgtgcaggtttgttacatatgtatacatgtgccatgttggtgtgctgcacccattaactcgtcatttagcataactcatcctaatgctatccctctcccctcccccaaccccacaacagtccccggtgtgtgtgatgttccccttcctgtgttcatgtgttctcattgttcaattcccacctatgagtgagaacatgtggtgtttggttttttgtccttgagatagtttgctgagaatgatggtttccagcttcatcacacgtatgtttattgccgcactattcacaatagcaaagacttggaaccaacccaaatgtccaacaatgatagactggattaagaaaatgtggcacatatacaccatggaatactaggtggcagtatgtttttaataaatctcaactattgggccatcaactgcagtagctaaagctgacattcttgaaaattcaattaatttttcagtatcactgcaagagctctgatcagagaaagtagttctgtgatatctccagggcatgaatcaggtaccataaatgcatattggatggttccactctgctgacaacaatggattccaagatgttttcaacattctctccatccaactgaggcattattttaattttcagtgaaacatttatgttcaaagatctttttcaatgaagagacaaacagttttatcattgagagaccatagaaaattatctggtaaggagaaagggaagaaaaaaagatagaatctggtctgggagtaaacagacctcctacagagcatgtgcattttttatctctggatggagggagtagtgatagaaagtctaatggagtcagctggattactgatctattccctggtgtagttaagcagatggtagggctggctgttatgacactggtaagaattctagcacatcgtcatggggatagcatgtaaatgaagtctcaacattttctacgtatcttattctttaccagatttaggagtaacaaggcggctctcacgagatgctagacagatcaaacagaaaggtggatatttggaaggaacagtcttctcccactgatgaggtgagttgaaccaaaggaagaatgtaagccataagaccccttgactttctaggcagtaatgatgctgtgccaagaaaaatgagacagcatggttgggaatcagcttctgataaactataaacatataattataaacggtactggagaaacttaatctgtcccactggcgacatactatcactattatgcccccgagagggttgatacatcagcaggtgttgcattctcccctgtaataggtttttaatctcaggactattttcatttgattgtcaaataactcacgtcctggaatcagagctcaaatcgctttcaacgcatcagtgccagatgatctgccttcctggatgtagaaaatggccatcagtggctacaggtagtcaaaccatagcaataaatatcacggtgagcacctacaggtattcaccaggaattgagccctggaatattagtcattgactactagcaaattattagccaagactatcagtcagaccaaataattctgagtaagtcataggaaagacctcccaatctgtaatagtgaatccctcccattcaaacgctcagaatattggctgagcacctcccaagtgttaagcccagtaccagttattagagataatgaagtgaacacaatggacttaattcctgtctcggaaagttatagtccaggtgtctgctcccctggtcagtccaacatggcaagtggttcaatattgggcacaagtacaactatatattactattatactgagaggaaaatgtgggtcaaaatatgagtttggattgtaggttggccactagctgtcactagaacaattatttgcttttcaaattttggtttctgaaaatggttagagataccaatctttcagaatgaatgtgaagatacaatgagataatgtctgtgcagacatctggtaaagttgatacgctggtgataaatagtcaatgtcttcctgcttgcctaattaatgtgataaatgtgataaatcatctaaaacaaacaacataaatcgtatgttattatgaaatctagaattttctctttaagataaaaaacaggacaaggattcccactgtcaacatttatattcaatgctacacttgacattgtagctaatgcaggaagacaagaaaagtatatgaacattgtaaagattataaatgaagaaaatcatgtgatataagcaaatatattgcacaaattgaaacactaaaataatctacagaaattatttggcttaataagagactttggaaagaatttagagttctgtgtactagagacaatcaatgtttcaacatatgtaaatagattcatagattcaatgaaatcctaatcaaaatctcaaaaaatttaaaaaaacaggtaaaaagctgattcttcacaatctatgagaaaaaaaaagagtcccaaatagccatgatatgccagagaaagaagatgaagtaagttgcctgcgtaaagatggacatttattacaaaattatagtgctgaagaaaatgcattaggataggtaaaatgaggagaataacgataatcaaacttaaaatattcttaagcatatatgaaaacaatttacactgtcaagcatttcagataagtgtgcaaaagatagattagtcaataaaggttactgggacaatcagttattcataagaaaaaagtgaaattggatctttacatcctttgttcacaaaaatcaattctacatggatgcccgatttaatttagagaggcaatctgtgaaaacttgtcagacaataaagtttgatatggaagaatggaaggacttctaaaattagcataaaggcactaataaatattgatacactcatctacattaaaattaacaatgctgggtcatcaataataccatagagtaagaagttaaataacaattttggagaaaatattttcacttcctattaatcaacaaaggattataatccagaatatgccaagcacctcagcgaatcaatacaaaaataaagacaaccaatgaagaacacacacaaaagaaatgtaatttcatggaaaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaaaattacattaaatacacatcacaatcttgacgagaagttaattattagcaaatgctaacaattaccaggcatctcaggctaaggtgatgtgagaaaatgtctagtattcataagttgtcaaattaacatcaaagcaatatcaactaaagagcattaaaaaatagcaatgccttggccccagaccccacctcaatgttctcttttaattatcaccataagacttgggcactgggagttttagaagcttctcaggtgattctaatatgtggaaatggtaaaaacgcagagtttagagagatatgacctaggcattcaatgtgtaatatctgtggctctataactgtataaactttgtgtaataatatcacaaaaccttatggttctttaaactaaaattatactttagatatgatctatgtataatattgccttaaatttgcatactgcttatgtaacttatcaggaaactggcatattttctcttataaaggagaaacacttaaatgcatttcttcctcccctttcccaattaatatatgcttagatgttacattatcagactgacctttgtaagcatctgattttaactctcaagctttctttgtaagggccaatatttatgtaaaaccacacaaatgaatatgcaatcccagaagaataaataactatgccaatattacatactgcctttgcaaaggaaatatcatctgagagtaatataggattgtatcttgcgactgacttagacaatcacatttgcccagatacagagaaatccctaattagctaaattcagttgttttcaattttttctaaatttatgatcgtagcctatctctaaaactcattgtacaaatatatatgctttaagtatttctggtgaaaccttatgtaaccattcaaagaaggcaactgtcgatattatattctaaagagaaggtcatggaagaaagtcttgggataaaataagtagataaagaaataaagacaaagaacaagagctagtcctgaaacagtttaagagaaaagtagacactccatccatcagtagcttttcctggataggctcatctttctttaacaagttgacacatttgcaaactgcaggctgaaattttaaacgtctaagctgcttttccttcttctaatagaaaaggtacaaaaaatggtttttgcttcctttactgctgtgccttaataaacatttggctcaaggttttaaccaagccaaatgttgactaaaagcctcctcataaaaggctttaatacatttttgcttgtgttttctttacatgtatttcaatttgatgacaaataatttcttccccatttccctcatttgctgctgcatgttggactaattaaaaagcaggctctttggaagctggaatgagagaaaatggaagagtgggcaggtgggtcaagattgaatgtccctggctctggcaatacataggattctcttcagtgaaacattctccatctagctcagattcaaggaaggcaccgaagaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggcccatgctttgtgatgccagacctcttgctttttactgcctttatatacatgataaaacatgatttcagtcagagcaagtggtatatgactcctgacattgtgtgataacacagcacattgtttctgtggagaagtcaacacagttctggaaggatgactcgctttccggttttatgctctcttcccctgaatcctcataagaagctgctctgaagtttaaacatcgaataaaaatgcttccaaacaattaatgcgacagcaaacacaccaataaacctatcggcagcagcctcagtattttacctcagtctttaatgtcagcttgcttttttattccagaggtcagaaaaacaaatgctctgtgagctcattacgtgcatgcctaaacaagcagaaaagtaggtgcttttccaaatgccagacaatgaaatctagatttttctctttgtacttcactgtaattcgggtgatagaatacttgctaatacaagctattaaaacaaaccaacaaacagaaatcagtctctcatagcctattttaaaactccctccctgtgttcttaactgttgacttttaaaccaaaaatgccagtcaagaagtacaaagtgatctttagcactgtctagcttaaaatgttgatagttaatatttgaatataaaaaagtataaaaataaataatagacaactcattttagctaacactttggaattaactttgagtagtagaaaactacacaatataaacctgtttttcagtggtttctgctatcaagtgaattgatggattatagtaacctttgttacctggcactcagaatactacttttaagcacaggttcttttaataagaaactaattgatatccataatgtgacccaaataaattgtaaggtccttgaaattaagttctggaaaaaataagcaaattcttaggcttattttattttttctgtaattctttaaaaatgagtgatctacatgtcatacatgtatatggtaattctctcctgtatagaataccctctggccatcctgaaaaataaaattaactcttgagctttatgagattttctaaagaaaaagtatctctataaagaatgttagactgggcatggtggctcacacctgtaatcccagcactttgggaggccgaggcaagaggatcacttaagctcaggagctcaagaccagcctgggaaatatagtgagacctcatctctaccaaaaataacataacataacgtaacatgacatgacatgacatgacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatcccttcttttttccattactcacaatgatgggattagtacagcttgtactggggctttggaactgtaataaacaaggagcaattttctggtcctaattaactcctgttaaaataagcactgcacaacaatagtctacccagagttgcactgaaaaaaaccacaacaatcctaacactctatgaataatgaaccctatttaaatgagcaggttattgtagggtcttaatgagctgctctgtggccacagggcacatactgcatcccagagtaatggagcattttcctgcagacacttgcaggctgggctagcagcagaacagcttcttccctggtaaaaccagagaggtagcatcaaaggtttgttatgtttccattttactttttcacacacctcttctgcaactgacatcagccatccccatccctttttgaaatgttgtcttccttcttttacctccaggcttctatattcaagcatcctcctcctttatatcttttctgaagtataatttacagaccataaaattcacttcgtttaagtatacaattcaatgagttttggtaaatttccagtgttatgcaaccatcattgcaatctaattttacaacattttcattgcaccaaaaagaaactttgtgcccattcgtagtcattccctcttcccacccccaggccaacctaagcaaacactaatctttttgtctgtataggtttgccttttttggacaattaatagggaaccacataatgtgtggacttttagcataacgtttctgaggctccatgtagcatatagcatgtggaacacaatactattccactgtatagatatactacattttgcttgctcactcatcagttgatgcacatctgtgctatttctacttcttgttattaagaatgctgctgctatgctgtgaacatctgtgaacgaatttttgtatagacacatgttttcatttctcttaggtaggtacctatgagtggaacagctgagtcatatgataaatctatgcttaacagtttaagaaactgccaaaagcttttccagagttttgcattactagcagcaatgtatgaaggttccatttatccatatatttactaacactggttattgttgatgttttccattatagccatcctagctggcgtgaagtgttatcttgtggttttaaccatttccctattggctaatgatgttgagcctctatcatttgtgtctgactgttgtttctgttttattttgttttcattcctcgttttagtattccttgacttttgtaatgtcccctttttcctgtatacctatttcctgatccacatggatcatgttgactcccactcatatgcaattaactaccatatcttaatgaatgctgctcatggctcattctcaatctatttatctccatgaagttactgataccatatgttaaaagaaaaactttagacaaaccaaatctagcagagtttatttgagaaaataaatgatttatgaatagggcagcagtctggaccaaaaatggttcagaatgctccactctaccacatgtgcagtctatattcatgcccatagaaaaggaagtaacatacagaaacaacctgattggctgcagtcaatgtttgccttatatagtcgtatttggcagctttcagtctcttaatggctggaggtttagttgctgtgattgattgagactcagttactttttacaagagtatatacttctagtttaggttatagcttgtaaatacaccaacttaggttacaattcactatgtctagagaaacttttaggcaactcttaaattatttatggaggcagttttggccaaacttaattcaatttcatacatatttctacttggaaaaaaggcaggaaaattgaatttttaatttacacacaaataatgaacagaagttcaaatgtaccttgatttaatgcataatataattgcgtgaagtattagtataccataatcgttcataaatatattgcttttacataagcatactgaccacatgatcagacttgcctgttctcttactgtcttacggacagtgtaggattcactaagctgcggtcatttcctctttagaacctagctgtgatcatcttctctgcctgcctcttactttgtttccttcattttcttttgtgacataatggctgtagctgaagcatacaggtagaatctcactatgccccctactttcttctcttttggccttttcatcttttttttttttttttctggttctccaagtccatttatgcatttattcattctttttctctttttttttatactttaagttttagggtacatgtgtacaacgtgcaggtttgttacatatgtatacatgtgccatgttggtgtgctgcacccattaactcgtcatttaacattaggtatatctcctaatgctatccctcccccctccccccaccccacaacaggccccagtgtgatgttccccttcctgtgtccatgtgttctcattgttcaattcccacctatgagtgagaacatgtggtgtttggtttttttgtccttgccatagtttgctgagaatgatggtttccagcttcatccatgtccctacaaaggacatgaaatcatcattttttagggctgcatagtattccatggtgtatatgtgccacattttcttaatctagtctatcattgttggacatttggcttggttccaagtctttgctatggtgagtagtgctgcaataaacatatgtgtgcatgtgtctttatagcagcatgatttataatcctttgggtacatacccagtaatgggatggctgggtcaaatggtatttctagttctagatccctgaggaatcgccacactgacttccacaatggttgaactagttaacagtcccatcaacagtgtaaaagtgttcctatttctccacatcctctccagcacctgttgtttcttgactttctaatgatcaccattctaactggtgtgagatggtatctcattgtgtttttgatttgcatttctctgatggccagtgatgatgagcattttctcatgtgtctgttggctgcataaatgtcttcttttgagaagtgtctgttcatatccttcaatctaatcagtagccaatatagtgattccattcaaaggttcaaacgatgcttaaaccaaaattattatccatttcacactctccaaccaagtgaacaagaggaaagaggagaacaaagcaaggaacaaaagaataaaaaaggtctaattaatttgcaacctggagaaaacatgtcagatcttgatgtaaaatagaaaagtctggaaaattgggattttccaatatgcagttatgtggccaattttagagatgcaataaactgagtgtgattaaatggtaaattggactgatcaggtgagccatacttttcttgtgaaaagtagcaagcatggaaaaaaaaaagatacagctctatttccctttacttttccatctgtatctttcatatttttcaaaattaaaaaaaacaccaaactatttttcaagtattaataaagaatcaggaagaacttcatttaaaacatttttgcctgcccttcaaaaaactctttcactgtttcaaggccattgcttctggaacccagatttgttctagcttacagcctaggaataagaatatatactttcctgtcaggatggcttttgagaaactctgagaataaaatctgacccagtccaatctgacaaggttgctgtgcttgtttgaatgtaaaatgattcacaaagtgaaccgaaagtttttgttaattgttaaaaagcctcagcgctgtggcttagtttaagagctacatctggcattttggtaggaacaaactacttatgaatgaggaatagttatattttttgtgttgttgtttttatttttcttttggggggggagggaagaaagaggacagaagagaactaggacttagtattttgaaaactgggacatcatcactggcctacccaccacataaacgtaactagtgtatatgattttaactttgtaatcgtgtacattgacacttctttttgatattctagatctatacaaagaaaaatactcaaagagatgcaggaaaataaataagaaaagaaattctctggccagcaattatttagcagtaaattgacatataaatgtggtgtaattaaactcaaatcacttttaaacctaattaccgatacaaagaaatgggaaagcatcgacctctaggcttcagaaagcttaggtaaaatcattacaaatctgtcagttgtaccatcaaaataaatctggaatctaagcacttcttatcattttcattgctgccaccctggtctgagttacccgcattttctgggacttctgaaataacttccaaactattgttcctcagacttaccccacctctcatacaccacttcaccccctgcccccaaacacacaaaagcaaagtgatcttttttaaacttaaagtctaatcatgccccttcttggctcaaaacccacccatgagaaattaaataggcttttaaagttacgtatcaattttaaaagtaacacttataattctatactctaaagagtacctgagtctgtactaggacatttgcttccagaagtcatgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactccattcaagctcaagggctactgaagcatagtagcagcttacaaagaaaaaaaaaaagacaaaacaaactcttagcaataatgttatgtcattcacactagagacaaaataacttcattattagagatgctatcattgaaattaattcactggttataaaaggaaggctatccaagaatatctgcagttttgatgccttggaaaataaaattaaatggaagagaaattaacaataataactcagaaataaacactattaatattttatgtaagttttccaccttccttgatatatgacataagcattttcttaactcaataaaaactctaaagaaacatagaaaacaataacaacaacttgtgtggtttctcgtctctctcagagtaaaagccaaaatcctgaggatagcccgtaactctatacaatctggtccaccatttcatctgtgggctcatcttcaatactaccctaaagcctccagttttgctttagccacatccatctccccattgactctttaataagccagacagttccctggattttggcatttcagtggctccttcctctgcctgctaaattcctctccaacatgttattcactgtgtgctctctcacctcttctaagtctttggtccactaccacctacaccttgcctttacatgccttgctttatttttctccataaaacttaactactgagtataccatagttaatcactcatgtttaaatattttttcgtccatctcctacagtagaatatgagtgacagaggacagggatcttcattttttgtttgtttggtatacccagggcccagaatgatgccatactcatgataagcagttccgtaaagagcgttattccctgtgacagaatgtcaggagtgaagttgtcaagtcctttttctagagaagtggtgggtgttcttgcttctcattaactaaggcacagcctggattgaagagtagacatgagataagagttctgtgttctgccatcaaaaagacaaaaaagaagtatacatcttttcaattcttttatgcttgaaattctcaccttcctttaaatcacaaggataatctgttgacccttacaacagctctgagctgttattatccacaactgagaaagaaaggaagaggctgtggtatttactgaggtcctaaatggcagaaccaggactagtaaaccatgttattaggtttctgcttctatatagtcacaatgaactgcagccacatctcccagaacaataaattagcaagtagacagaagtctttctttccaccctcaaaagaggtttttagcctttacaattagcttttcaataaagatacaagaataactatttcattgatgtgctctcagcagatcttagactttccattatttatttcctttgtttagttcaatgtgaaagtgcttggctttaatcttcatttcacttagttttatcaaaatataaaacccctacatttgcataggctatcccagggtccagaaagcattcacactttgtccatctgatacaccctcaaaacaacgctagctgaggtaaaagcaggtgggtgtatctttacctcagaaggatccttgacctgcccaatgcgacatcagtggtgagcctcagaaacagggcaaaaaaaaattgatctctttagtgtaaactcaatgtttttaatttacaggaaatgcattcactggtgtgtgtgtgtgtgtgtgtgtgtgtgtttgaggcaggggagcaattacataataggaagaaattatctaaattattcttatttcacatgtcttctagaaatataattgtcacttttgcactccacttccacttcctggcaatttttctgctgccataattcaaaaacagactctttggccgttccttcacattcctttcccttttgtctttacagcctcatcacttccttctaccgatcttcatttcctgcttttgagactttcccgctgcctcctcctgtcatcttcaggtcccaaatgcagttttgccagattccacatccaaaattaacatcatttcctctttggctacactagtaaaggtgcttccttttatccctccagatccatatgtagcccaagtttgaagaactttcttctccctttttagagttgtataagcttcctgagagctggctctacaatctccatactctccagcccacatcacagtacagcactgaaaacagtgccttttatactttgggtaggcataggtatttgagaaatgagccatgaactcaaaaagatagcttcagggaagtcatgagcaagggtgacggcaggaagcactgcttgcctttcttcaccacccaacttctgccctctggccctttttcagtcctccactttgctccccactggcatgccacacatgtgagacagcatgaggtatgactactgttccatcaagtagggaggatgctgaatgcatcaatgacacattgcctcaaggttccattccactataagtatataagcaattgttctttggccagtgcatgtttttatgcagtaaactagttctcattttgctggacatttattacaacatttacccattacaaagaacctcattatgtttaatatatatgaaaacacgttcatttgataggcctattacttgatccattttatttgggtatacaggataacacaggatattttccttcaataaaatagtgagaaatttttgatctaagaagcttcaatatcacttttttttttagtacgcaacacattggtatactgtctgggggcaatctatataaatggaatgaatcctacttaaaaatcatttgttgacataaattattgagaatttcatattttaaaaatattataaatttctttacatttagaaaccaaatatacttctataaatgccacacttatttggaatatatttctgtacagtgtaagttgaatattcatttatatttttctgcaaaaattagttgttcattctttaattcatatacattttagcttcctttttcttttttttttttcccaaatccacaacttttaaaaattttcaacaggacttccctttctgaaagttaatgccttgattaacatttcacaataaattataactatgatttatacttgatttttctttgatttcattctaaattaagtttctattttaatatgattagaggctttgaagaaacaatgggatctgggaaacatacttccgctttatattaaaaaacagatttatcattacaattgttccaagaggactggcctttttctattttattcattgatttatcccaacatctagaacagtgcttggtgttcagggggcactaaacaaatacatcaaatgcctcctatccactgcactttacccactggggacttggaaggtcaggagaggcccttactgtgccagacattatagtaagcaatgtcacataatctcatttaactatcataaatattctttgtggtaactttcaacatccccatttcacagatgaggaaatagatgcattgagaagttaaggttttcatgtaagataacagaggtaataaattgcaaggttagaataaatgccttgaagtctgtctgtctgcaaagtctaggctcttaacaacaccctaagttgcctgccttcacccaaaagtattgtaactagaaggaacattaattactcttcctctatctccacactgtatatgaatattcagactgactgagataaaattacttgcaaaaagaaatctttgcaagtcagtgccacaattaagtcacgacctagtaccattaatctgttttggtttttagaagggtggcattctcctaccttgaaacatcaaaactcatctaatgagaagagaccttgttcaagggtaatgtgtagcttgcagttagaacaggtgagaggcttgacagtagcaagaccgactgctggtttacagcaatgtgaatgtctggtgcttggactttccaggaagcaggccagtgccatatttctggctggctgtctctgacttgaatttagggtcctccaagatactggagcactacctcccagaacctcacgtagtccattcatcaatatatccaacaaatatatatatggtgtttcaaatatgtggtaggcactgatctcagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataaaaggcatagagatatttatccttcaaattaaaaaaaatcatgtaatttttggttctttcacatgtatgctttcagaagagaaaaaacaaatcatgttaaactttacagtatcaaatgtgataaactaaaagcataattaacttgttctcttaacataatatggttgttttgctagatcccagtatactactttttccacaggccacgtttttcctcagtatgcacaaatgaaaaagagattaaagaatttgtgtgacctacaataaggtcagcttctaattattatgctaattccatgtactagatttaatagatctactacttttctaccagttaataaaatagactctaaaacactatctactatctaagaagggtgccctctcataccttaaaatactctgtttgaatagctgtgaaggatagtaaaatgtcttactattctgttattgatcctgaattttaaacagataaatgccaaccagaattaacttatttcatgcagcaacatctcaactctttatgttttatttttgaaagagccatttttctgaaattcccctactagataaataatctgccgaatcaaataactgatctattggcaatcccctcaactgaccaaataggctacaatgagttaatcacgcaaaatgctcaccacttgaagtcagaaatccaaattttgtgctctcttcaaccgactctgcaaagtatttgagcttgtgacttatttgagaaagtaacaatttattaacaacacagcgtataaaatggtaggttttgctgtggttttggaggtcagtttatcaaagtgaggcccttctctaatcatatgcaagaattgaatcaactaaaaaacacatgtttggatggatcatataatttaaaatctggattatgcagtgtagaactgtgaaaaaaaggtgaaaacctgctttctattcttggttcaattaattaagtgtgtgtacctcccaccttttataagcatcttcttaagacaccgttgacattcagtaaacaacacatgttgaaaatatgtaatataaaatatcatagatgatattttatacatctatgaaactgcaaaataatcaaaggtaacaagcatacctatcaccccatacatttttcgagcctctttgtaacctcttgttcccttccaccgattctcctggtaggaggccaacatttatgtgttttctgtcactacagattagtttacaatttctagaatttaagtaattgagataataaagtaagtagacttttttgcctggtttctgtcactcaacataattattttgagattcatctatgatatgcacatcagttgttcattcgctctcattgctcagtagtatttcttgcatgtatatgccatattagtctatgcaagttctggtggtttccagtttttgtcttttacaattaaagctgtcacaaacattcaaaaacaagtcactacagtgaatttttctttcatttctcttaaacaattactggggagtataatggctagattatagggtaggtatatgtttagctttttagagatatatggtaggtataggtttaacttttttgagaacctcacaaattattttccaaataattattttccaaagaagttgtaccatttcacattcccatgaatggtatgtgagagtttcagttcttccacattttcgccaacacttggtaagggcatgacaataaacagagtgtttgcttcatgggaataaatgattgtattgggatgtttatatggctgcttcttactctgaagttccatcattcagaatagattatgcaggtaaaaaaatagtcaacagctttaaataccaattgtaattgttacaatattttagaactactaacccagtattctgggtcaaaccaggtagacagtatacattagttccaagttccagagcataaaataatgatgatgatgatgatgatgatgatgatgatgatgatgatgtgtgtgtgtgtgtgtgtgtgtgtgtggtgaagctcatttaaaaaactttattgattctaggattagagaacacacgcatggcgtggtgagagtatataaaagagaaatccagtgaaaaataactcattttgcttttaagtagctttacttgaatgaaatttgctttattaccatatacttcttcattcttcaaaagcaattgggatgctttactcatttatgaacttgtgcttttattctaaagatttaaaaaatttataaattgaaatataaagaatttacacaatttctttcatttttacagacttagtcaagtaaactgcacttttctttttctgatgatgcatcttaattgcatattatcaacatagtttgctattcagcagggacaatttcataattgctatcttcagagaagtaaaataatagagggcttcttctattaacatttagtaaagtgttacaaatagcacttggtgaatgaagggcttcaaattattagaaggacataatattggttacacatgttcacagaataagaaagatatttttagttcctttcagtatatcaatttctgtgaaataaatagcattctgcaagtaatgatatgttactgggcaagtaaagctatgttgttaatttataatgaccaggatagaatgtaatataaatgggatgagcaaaggaaattcgttggttcactgctgcatcaaatctgaactctgagttttctccttatatccatcctttaatgctcagctcaaaatagatctctaagaaacgttctctattgtttccctattacaaagtatattttccttctttaacatactgtatcccttcttatctttaccacctatatgtttctgtttttacccctggctttatattcctaagtattattgcatctttgtatctattctaactgcattaaaagttcccagagttttggagccatagtctgaagttggttaagccccagtgacaaagtttactagcatctttctcattacttacatttgtataatgctttatgtatttcagaaaattttcacatttgatattgtctatggcataacaaaatgccttaaaccaagtaagaattctatacatcactcatcaatgatggtttctcttgggttgtctttgtgtaataagatgctttttagaaacaatgggagctgtaaagtatttcgaatggtatttcaattctagcagtgtctaatgtctcaacgtctcctttctttttcaacaaagcctccattttactgctttccagggtcacacttgattatccattcagagcctcagtggcattttcacagatcatacactatatgatatgtgggacaataaaataaaatagtgaaataagagtgattatctcaaggtctccttacttaatcagtgttctttttttcaagcttaagggaatggctcaaagagtgaaaaatatagtcaacatgtgaaaaatttttgtttgcttctttacagtctacaagcttattaaatcattactgcaatatattctccagccaaatattggtatccataagttatatgaaaggaataattgcatatcatgcagcaggaagaagaaaatgcattgattatgggatttaagaagaaatactgctctgtaactatctgtacaattggtacaataggttgtgttttgctttaaactggacagttgtgctgtgatatcaatatttcttctcttggagtagcttagtacaaccagcggcaaacagtctcctcaattacttcaatgtgtcattcaaatatcatcattttggcgggcattctgatgtgtaaaagtttggaacgcatggatagcattaacagcatagggattcctcctcctcctggttacagagcatgtgtatcagttttgtgccttagagatacagcattatggaataggaatttcaggtgggaatttcataatcaaaggttatgattatggggtgagagaaatgaaggaggaggtaaatagaggaaaggtcagattcaaacccagatgcattgtgatatacaaaaagcataggctgtttttcagtgtcgaaataaaaatcgctgaggatggtgctggtcaggggatacaggccctccaggtgatgaagtttatgggatttgtgggaactggagagaagaaaatctacgcaggagaaatgggaggggaggagtggtggccatcaggaaattgagtgtagccagctggtctgaagaaagagtttactcaaagaaataacaaacaatgcatttggggatttaagctctgagcatgtagaaggcaaggctcagtcttactttagttcgaccccggtgacaggcatgggacctggaacatggtggagctcagtttattaagtgaggtagcaaaaaacagttgaaaaaactcggcaggattagggagactgagctttatctttttaagtctttgaaaagtcccagagaggttttggagtagaatataatttttcctgaaatactcattgcaatagaaataaatagcaatatcaaaaatacaaacagaaactatctttttgtataacattttaaactttacaagatgcttctataatcactatttattatcctcacttggagatacagcataactattaactaaccactgaactatttattgctaataaagtagacagtatagctaagcaagtttcaaaacaaattattttgggtgacacatatcacttgaataaaatactatataatattctaataatgatttttaaaaggtcctttttattcccatccatcattaaatttgtcataatcacatcccagattataaacaatgtaaattaatatggtaaccctcatatatatgtagagatctgagacaaaaattgtgatttttttacagaaatgcatgttggcttttccacagctactcaaaataaataaataaataaataaaaatagaaataaaaataaaaataaaaaaagataaatccaaaaacaacaacaaaaaaaacggaattaatcagacctcaaatttagaatagtaatctccaaaaaggctactgctagcataattttcaaggctaatccaaaaggagaacacaacatgaaccagtaattccaacacataatttttgttatagacaaaataaattttaggagtagttttatacatgtatagtccatattgtcacactgtattcaattatttttaatcctagctgcatatatttatctagggaaaatatgaatcttaagagcgttgcactatgtatctaatgaataaatacaggtcttttctcactctgctatattcctaaagattagttcaaggtgaaaaagcatcatacatgttccaaaagtttgccataaaatcagtaagaagctgttcacatttatatattaacaaagtaatcatttatcattaaaaaaaaactagtgaaaacttaacaagtgctcttccatatatttaatgctatttatttttattattttgctgagatataggtatggctttctgtttttattgtaacgtaaacaatattaagtataactttcttttaaaaaataattttagatttacagaagagctgcagtgttagtacagacagttaccatgtatgttcttcacccagtttgtcctaatgctaatctgttacattaccataggatagttattaaaagaaactaacatggattcaatattattcaccaaattacagactttatgtggacttcaccagtttttccatgaatcttcttattctgtacctggatccaatttaggatcgtacctcacatttagttgtcctgtctccctaattcccttggtgggagcactaaggaaacactgactcttttaaagagtatagatcagttattttgtagaatgtgctgctgtttaggtttgtctgatattttctcattattagattgaggttatgcatttatttaaagaatattccagaagcagtaagtccttctcagagcatgatgtctggaggtaaatgatattgcttggtgatctttgatcacttggtttagttggtgtccgctgtgttactccactgtaaaagttactatgtatcactttagagttaataaataccattggaaagacactttaagattatgtaaatatcttttctcttcttaaatttttacccactaattttagcatgtatctgtggagcttatctgctttaatggtatcttttttgtaattcaaaatgtgtaacttacataaatctttaaaaacatgacttctacaaagcttgtatctatttattttcttcttctggtttcctgacaatgcaaacaaatgttagagaatttatcttgagaacaacatttcccaagttgctatagaaaccaagtaatgaagaaaagactaataacttttctattctatatagtatataagaaatttaaaaaattattttagtgtttaatctgtttggctattttcacagaaaatacattttttttctgtgttgatagctaaaattcagattttccagtagctgaatatggcaaaattatatgatataattttatatacttcttgatttattttatattatcaatatcatgttcaaatcatttttctgataattataagtgatacatatacattacaccaaatttatttaatattcatccagtcagataaatcaatttttgcttattgcatgcactttttataactaaatatatactattgataggaaatggttggagtgtaatttgtagtataagaaagcatgctggccttgaggaaaagcttttttgtatttaaatgtaatgacacattttaagtacaacagtaaagaattaattattgaagtagagatttgtaaattcagcagtaaattttaaccatcaatatatattttgctattttgttaagctaacataatttaagcttctagtaagtatataatagttgtaactgcacataaaactttagagaacaatggaaattttccatcagtgtttatgatagggacaaacccaaaaagaaaatagaatgagcttattacgatttaaaattacctttctgtatcttctattgtcattacattttatttgatctttattagttttcaacttttaaataaactttttaaatattcaacttggtacctaacctaatgtaaaaactacatgtaaaaatcaatgagaacaaatttatggtgacccataatatttaacgattgctaaattgattctgaaaatatgtaaccataatttgctataataccattaatctctgttgactatttacagcatttcataggaacttaaataatttgattttttacacagcaattcaaaattttcttactggcttcttcattatgtatcatcagctttcagctataccaatgttaaaaaaaaaaagccacaaatcacagttagtccagggaaaatttcttgtgaattgtttttgtttgttttttaaagtggagtgtaattgctaaagttagtctaaaaccatgatttcattcaaatgtggctatgctttattctacagagaaaacttgccttggtcataaaatttatgtggtcaagaggtaacacatgcttgatgagcttgatttgcaattttaagttgtggttaaatccctagggaagcacagaattctttatagaggtcttagaacaacaaggctggaaatagtgttacaatcatccactctgatgttatggtcctccacccccatttcagttttcttatgagtaaaatgtgagtatcaatattttgcttagcaaggtttaaaaaaaagaggctaaatgaagacaaaatgatgttcagttgaatttcccagctctgttatagataaaatattatacacattttatgatacttaaagaaaactgattattttgaaatttattaaatatattttaaatggcaacattcagtgaaacttttccatgaggtccctgcaatgggagatctcttatgaaacattagttattaaatcaaacatgcttttgtgtgcaccactatgcatttataattcaaacatatctttacatttgcaaaacactatattgagatcacatctaatgttattcaaccatcattttgttctagcttactaaactggaaaataaactgtttacttaactggtatttatttaacctgaacatatctgcatatattacaaagcagacaataacagtgggcaatgtgatatttgaaaggagtggagaaaatgaagacggtggcaataattaaaactaaaagtagtttagagaagatgccagctctcagatttgcttatttatctctaaggatatatgtgtaaaaatgtatttctattttagcccaaaaattatctagcacaattttaattacaatttattatgtgagaaattatgatgcctttgatactatttaaaaagacatgtttagatctaattattttttctaccaatactagcaaaaagtgcttatttgctaaattatatatgtatttgaatgaaaataatatgaagccagagtcattaaagttataatttacagcaatgcctacagtacagtatttaaattgcttaattttttcctttcaggtagaaacaaatgtaaaaacccaatgattcccccattctatgcagaatacaagagaaaggtaatcttcagtactgctcataaaagatgtttacatttagcagtgtaggaatcatggctgggtgtgcaagattattaggatgcttcagggtggttgctttattttgttttattttgcaggaaattatgtaaccagcaaacagacagaaaaagtaatttgttgggaatatactagcatatgaaaaaaaggacccattcactaattcatccatctatctagccattcagcactgattaaacactttttatttatcagggtctattttacttagtaggaaaacaatgacatgtaagacatagactaccatcttcaaaagcttccaactacaccatggaatactatgcagccataaaaaaggatgacttcatgtcctttgcagggacacggatgaagctggaaaccatcattctcatcaaactcatcacccgcctgtcagggggtggggtgctgggggaggcatagcataatgagaaatacctaatgtaggtaactggttgatgggtgcagcaaaccaccatggcacgtgtatacctatgtaacaaacctgcacattctgcacatgtaccccagaacttaaagtataataaaaaaaaggaaagtaactcattaaaataatgtgtaataacagccttaggaaaagtgtttacaaggtatcatggcatttacagaagagtatggaactcttggtgatattgcctggaagggtaaagttagaatgaaagaaaagtcattctcgttagataacagagcctaaataagggcataagaaacataagttaaaaacaaactaacaaacaaaaactccaagtagtctggacatcagaagcatggaacagaagtggagcacggacagtagaggaaagcacaaccaatgactcaggcaggcagaaaccaaatcaaggaggccttctctccattcattcttaggccgtggagacctgggagtgatttttagacaggaatagcataatctcattggaagcttacagtattaagtatggaaaatagaaaggaagcaaataggaaacagagaggtgagttgagaggctactgcgatagttcaggtggaaaatggtatgtctaaaacagtagtagtgacatagagaagacgggtgacacctgagagtgtttgggagtagaaagggcagaactttgtgatcacttacacatggagatgagacagtggtaaaagttgaaaatgactcccaggtttttagcttgggtgaataatggtgtagtcaacacagggtgaaaataaaggaagaagaatatgttttggagcaaagataataagtttaattttaaatacatttaatttgaaatgaaaatagactagctatggaagaactaaatgaaaatagcccagtgatatggtttggatgtgtgtcccctccaaatctcaccttgaaatgtgacccctcaatgtaggagatggggcctagtgggaggtgcttgggtcatgagggcagatgatccctcagaaatggcttggtgttgttctctgtggcttaaaaagagcccgacacctcttccctctcgctcctgctctcaccatgtggcacactggctccccctgccttctgccatgagaaaaacctttctgaggcctcaccagaagccaagcagatgctggcatcatgcttcctgtacagcctgctgaagtgtgagccaaataaatctctttactttataaattacccagtctcaggtattgacttacagcaagacagaagagactaagaagcccagaaattctacagactataaatgctatttgtgaatcaatagattttaaattaattggcgatactgcttgcgtctaacgtgctcctcaagtattttgggctgctagtcaataatagaaacatagacagatttcgagaatgacttaattcattgtgttagactacaactgcttggaaagcatagtttaaattcatgctgtatcaggaaatcaactagacttggcttgctgtataaataagcagcacaattaggaagaaagaagcatttgcatttggccagtggagtgatgataaactagaagattccttttgggacaacagtgaaatatgttaaatcaagctattccaatgcaatgtaaacaaacaatatatatcatctcagaaattcaattaaaccatgaatcatcttgtcattaccgttactccagtttactgttaacatggcataaatgtattttaagctgttaaacaggggcatgctattctttgaggaatctgaattttatgaactgtcacaagagcaataataaagatggagagtatcagctaagaatatccataattaacaaatcaatatgttctagttatctgcagtgtggttagctccatcaagagcaagataaaggatcaagaatgagaataaagagtgaattaagcagcttaagatccagtcaaaaagacaaaatattcattaataataaaaaaatcagagtcaagtcctgttgcaatttgactcatgtaaaagttgaactcatgttcaaacgtaacctccaaagttgtaggtgggcctagtggtaggtgtttgggtcatgggggtggatccttcacgaataacttggtgccctcccagagctaatgattttacaggatatcttgttttttaaaagagtctgggacctcacccttctctctcttgctccctctctcaccatgtgacatgctgactcctcattcaccttctgtcatgattgtaagcttcctgaggcctcactagaagcagatgctggcaccatgcttgtataacctatagaaccacgagcaaaataaacctcttttatttataaataacccacccttaggtattcctttatagcaatgcaaacagactaacacaagtcccgaagaagaaggttagatagattagaagacagattagtggttaagaggataggttttagcgtagaatgtctgggattgattttcatttctcctccatactagctatgtgaaattgggatgactacttattctcttggaggctcaattttcttgtctgtacaatgtaatatttgtgtccacttaactagttgttatgaaaatataaaacgataatacatacaaactgcttcaggcagcaccatgcatatgctaaccattcagtaaatgttagctctaatgataacagtaattggtattattattataaaaatcaagaaccaaatcatcagaatatatataagcactaaagagttccaaagaaaggaaaggtcaattggtcctgagctctttgttgaggcttgaaaagccagataagctttctgaagtaaagagaaaataagctattttaagtctctgttacaattcattcattcattcagcattcattcatttattttaaaattacacataaaacattgattaatcatttgatggcaggtgctcaaggccatgaaggtggtaagtgtgaataaaataaaggtttgtttttgagaacagtgagatataaagtatatgggcattcacagataacagggcagagggtagatctaccattgttctcatcctactccttctttgctgccaagtaagtatgaactatataagccacaaaggggcatgacagcttgtgcatatccttcagtctttactcttttgaaacattattgttaaaaatctctgcctttagaaatagtaaattataggcaaagaaaaacacggagagcagccaatttgggacattcccaaagtgttttttgttctagctctgtgaagagtctctggtcagattttaatgagttttcaatggccaacataattgatattctcttccagaatttaactttggcatgtctgtgtgcaggctattgaaagactctgggataagtcagtggtattttaacgtgaggatacaaatttcttaagttggctttcctatttcttgacactgtctaagaaactctactgtatttcaatctcttttgccaactagagggatatttttgttagcactcagtttaaaaagcctaccattttgactaaatttactggcctaattcagttacacagctaatcaatttagttaattcagttggtttgtggacctttcattgaattaattgattttttttttacctcaactggctgagagactagactggacttctgggaatgtattctctaagcacatataaaagacaattgttttgtgttaaaccctagtatgtaggccatgacaattttcattaaagaagtccagatataaaacaaaattgtaaatggatattccctttctcaggtcagtatttggaaaagcaggtttcccacccctccatttccaaacccattcctacttcttcgtgcatgtggagagaaccacaagaggcatattagtgcttcctgcagtacaaatcaccacctacttttaaacgacatctcagaaattattttaaagtatgacaaatagaaacatgtattctagaaatcatatttctaaatattaaattttccttcattaaaaaaattctatcatcttagcattcaaaatatattttttaaaaaatatcaattgggtaagggtctgagatattacaagaataattttcttccatcctcccaatagttagtgacatttatttagaacattccactttcttttctgcccaatgcgtctgattttatcaagtcaccattctaaactaagcactgcatctggtgttttgtttggtaagacagatttgtggggcaagttcaccaacacattatgatcaagcattgtttagattaatataacacgaatacacaaggctgtattacaatttaaattttatttcacatgcaaaaaacttcccctttacagaatttagattaatcccatggtttgttattgactatctttagaaagaatcctattattccaaatgacaactttgtaaaaatgcagtgcagctataatggaaagtacaaaagttatattaagataactcctttctgagtacgtgtatattcattttacatgtttcaactagaatcaactcttacaagtctgccttcagccatctgtatcactgaccagcattggaaaaacctcattttcaatttctcggcaccgttgacatttggacctttaatgactcattaaccctttacagcctccttctccagatcttttcaatcacatatgatcatgtcgccaaactgagatatttttgactgttcgttgctagtgcagataatattctctcctcttccattctcccagctcagtgccagactggactgtatatgtatgagatgaggatgataaatgggagaggagagagaaagccaggcaagaggtgggggagtagagcaagatgattgagcagagcaaattagaacccataagttatattttactggttttagaccctaaagagatagagcttagaatgactcaaaagggaatttatgagactatggactgcacagtgaagcattagaaattctagggacagatgtacggtcagagttgggaaggaaggaattgtctacttgttacaaggtgcagtgccactctagagaccacagattggtagctcttggggcatgtacaggcacatgcttaacatggatcgggctacattgagattttcttcttggaagaagaagatgttactgtcagaagagtatgtggaaaagtagattcccaaggagaagattagtaatggggtagatactaaacaatgagatagataccaagtagggactccaggtgatgggataggttttgagcatggggagacatccctctggaaggattcttggagtatgggacaaaggctgaggtcctcccttattttgatgggcacaatcaagccagcagacaaacaggctactcagaatcaaagaagaacaccaagaagtaatgttgtctgtctttagcaaggagcaaggaagagagcataggcaaagaaaaatatctgaaaatgttttagctctcccagaatcaagattttagtgtggtttcattgcttccaaaaattacaaactttccaaacacactagagtaaagctcacacaccacatattaaaatcaatgagagatgatctgtgattactcactattgacatggatcattgatgacagtaagaccctgcaaaataaattcccttactggacttacaaaaacctcacaaaaatataaaagtaaataaaattatctttattctattaataaagaaaatgtatatgaagaaaatgcactttacaaagtataagtaatttgccctgaatgacatggttactgttagaaccatgacttggattcttaaaggtttaatatcctgtcctatatgctatgctacctctaaacatcacctcaagaattcagtagaggccaggtgcagtggctcacacctgtaatcccagcactttgggaggccaagatgggcagatcacttgagcccaggagttccagaccagcctgggaaacatggcaaaacctcgtctctacaaaaatacaaaaattagctgggcatagtggtgtgcgcctgtagtcctagcttggtgggggttggggtggggggatgtgctaaggtgggaggattgtttgagcctaggaggttgagcctgcagtgagctgtgattgcacctctgcactctagcctgggcaacagagcaaagaccctgtctcaaaaattgaatttaggaaaaacaacattacatctattactttttttaaatatacagatcactcactgaatatataattataatatatctgatgcctgtatgaattaacctaagtaaaaaataacactgtttcttctgaatttattttgatttttctttgaatcgaatttattacccaagccactctcaagcatcctacagagacctatgaaggatgagttcttatgtgacttagctttaaaattaaaaaagaaaaaagattttaaaatagcaagcaagcttttgcttttcttaagaagtcaagaaaatggactatagatataggtaaaatacagttaaagagcaacattgttataatgttgatacaaagtcaaacatatgaataaaaaaaatgtcaatcaactggatcctttcaaatatctccccaaacacctggaagatgacaaattttttagattgataacctttataatgtaaccaagaatattacacagcctttgtgagatagaaattgttttaatataggatagaaatgagcagatatcacaatggtttgccacaagtaaacgaatttccttctttggataactttaagtaaagctaagttcaagtgaaaaaaaaaaaagctaagcatgcagtggaaaaaaaggataatctgtttggattcaaggttatgctattcaattctcaaatcactgagcagcatttacagtaaaatgacactctcatttatctcccaggcaagcattgagacctgccttaagatgcaggaggttagtagacttcatagcacttaattttctaacactacaataataatagttaacttagtaaaaaaaaaattctgtgtcttcacataaagtgaatcaaaatatatctttgcatcactgcctactgtaacctcaaggaacttattcatctaccaacagccaagacattaaaaaacagagaagttggtctctcaggatagataccctattcacttaaggtggggcagataatgcacagactctaatgttggatctgtacactattggccccaccttaggtgaattaaaccaacaacatcaacagggaaaaatgtgcaaaaactgtgttgttctcactttatcagtctttccaatgtttaagaagcacagattatttgctcagaagactagaccaactggaaattgaatgatcttgatctcttttaagaaaaaaccatttgatctaaatcttcaaataaacaaaataatttgcaatctgtgtcttatgcttctattttgggagtcagaccaggcatgagctgagtagcccattctgtcttggaggacaggagcaaaagggactgaaatataaagtcacatgtgggcattaaagaacatcctggagtcccaggccatataaaagggcttgtaattagtattttagtaaatactaatgagaatgcatgtatcaacccacattagtaaatattaatctgaagtaatattctaggactatttattaattactttcaactcttcccccaaggtctagtaacccacaaaaagcttgaggaagaaaggaaatagaagctttgctttgttgaactatttgatactaataaatatactgggcagccatgccatttttataactaatcaaagcaagtggtttgatgttaaatcaataatgtttatacaaatttgacttattagatacagtgatagttacctcatggctggaaatcagcatagtaattaaaattgtgttctgatatttattagttctatgatctttggcatggcacttatctttctaagcctcatgctgtctcatctataaaacagaaactgataacaaaatccacctatcaaggattctgaggctcaaatgagatggtacagaaaacataaatgtgcctggcacagggtgacagccaataaatggcagctgttggccattaaagacaaggcccattaatttgtaagttagtgcctactacaaagagcatagattagaattcacacctggattaattaattttcatcttctatgtcctaaaactcattcctccttgcaaactgggtgagactatgtagatgccccagcaaattacccagacggaagatgatgagcaagtagcatctctttacttaaaaagaatcatattttctttccaagaaaatcttcataaaccttagcccatttacataaccaagccatctctcaattggtcttgtttgagtttactatcccatgtcttcttacttttttaaaagaggtaagaataggctttgaacacagaatctggtaatagtctcaaaattatggtgctaaatttccttggcttatcaacattaaataagggaaaggaaaatctactaggagcatcgtgacttggttgacacacatatgagcacgaaaggtagggtaatatttttaactatatttagcgatgttatagcttggggtcagttcagaagcagaaagggtaaaaacaaagcgagtaatggtgacatgcaatattgtcctcattatcagaagataaaaccatcatactctaatgggctgatacagattgcaatttttagtagctgatatttccaagggcctagcaagacagagtgcaacagtacgtgtcacattctaaagtctaggagggaaaccaaagtgatctcagtaacataggaaaaattttaaagatatagcttatatatacattctttagtggactcaatagctgtattaattatgagacatggggggaattatctcaatacagccttgcacataacacatttgtatgcaagttttacacatacatctatacctatatatgcatataggtctatacacaaatattctgtaactacacatatacttgttcattaatcaaccattgagggcctacaaagtacagtgagtgaaaatatatagaggaagcaacactgagctgctgtggacacagaccatacttatcttgaaggtctctatcctgcaatcctaacttcccagagcagactactaatatattacaaagtaatctactttgtaatctgttagttttattgctgacggtattttaattttctgctatttggcatgacgaaccacagaggatcagaggcaaactgttgctctcgcatggaagtggctcctatatgaagacacagtgatgatgacaagaagcaattgctctcttaataagggagaaggatttaaaatattagttacaggccaggcgcagtggcttaagcctgtaattccagcactttgggaggccgaggtgggcggatcacgaggtcaggagatcgagaccatcctggctaacacggtcaaaccccgtctctactaaaaatacaaaaaattagccgggcacagtggcgggctcctgtagtcctagctactcaggaggctgagacaggataatggtgtgaacccgggaggcagactgtgcagtgaaccaagatcaagccactgcactccagcctgggtgacagagcaagactccgtctcaaaaaaaaaaaaaaaatatatatatatatatatatgttataaatggtagatctaggaacttagaaagtacagtagtttagtgtgagggcaaacagctttacatacttcagctgccccaaaggactgactgtattacagcacagtacagtgactgatgttcacaatgatggctttgggttatcaaaaagaagttaactcacgttagcaagttcaatttaacaaggtacgatgtgtgtattattttcaaaatggtaaaaggagcaagaaaagttttcttgcataaaacagaaggcattagttatatggaatgctcacttctgtaaatacatcttccctaatggtatgagatagttagtatacatacccatccatccatctatgcatttcatctttggcaattttctgttcttttagttaagataggttaccgactactcctaccactgcaaatatcaccaaactacaatacagtatactaattactaaactagattaacactgatggctaactttattatttataattgtaatttcagatttcatatgaatgataaagaattctgtaaaattacattattaacatcttagagccaggtggctcatgcctgtaatcccagaagtttgggaggccaagtcagaggcaggtggattgcttgagtctaggagttccagacaagcctggacaacaagttgaaaccccgtcactacaaaaaaatacaaaaatagccgggcatggtggtgtatgcctgtagtcccagctactaggaggctaaggtgggaagatctcttgagtccaggaggtcaaaactgcagtaagctgtgatggtgtcactacactgcagcctgggtgacagagcaagatcctgtctcaaaaaatggaaaatacaataaatttaaaaaataaaatttgagaaaaattgaatgaagaaatatgtaataatgggtggtggtatctgtcttactgcaggtaagttgttcctcaactaactctttctgcctcgaaggtggccataaattgacacatactgataatcgctaagcaactgcatggattatttaatacccgtcaattgtagattatgacaaacataaagagatagtctttgccaaggtccccagtttagattgttaaggtaaaaccctgaaatcttactttccctttcaagtttcctatactttattttagataaagctaaattgacatgtttagttttcataaaattgtaagtttctttgcttacatattactaatacttgaagagtactgggaatatcatcctgtccttgttaacaaaagtgaacagaacatgaaccagagaatttgaacttggagatctagatgatagctacatcattaagaaataaaagtagtcaaatggaatattcagttgtttttcataatatgactttccaaacattattataaattcaattttggcttgtttctctcctaaagaggcatgagccagtttatatactaaaactacacatctcacttaaacaaaattattatttttattattatttcaattaactttctttcatcctaacttctaagatgctattttggttgttctctttgatccgcctgtttttcttttgctctgtaattgccatcacatagcaagatctagcccttagccttctacagtctctctaaaaattaagcatatcactaggtggatttaaagccaacacactcaggaatattcagtagttttgcatgtcactagtttcctgatctgaccttactgccatatcatctggatatcccacccttttcaaatgtaagacccaaattacaactattttttctcccacaaactagtttattgacatcaccattatctccattgctaaggcttgaaaacgagtcatctgtttctttccagtctttattttcatttggattcatcacttttttctttggaatctataatttctatccctttacctctcttctcaatatcctccaatgagtataggatcccttaagttcaggcacaaataacttcagcagtctctagtctcttctctcctcaaatccattttacaattaatttgtctaattttgtttcatcctgtcagtatcgtattgaaaatactaactgaataacttgtaccatgttcttattttgaacctaaaaggtgatgcatcatctttgcatcatcaaaccccaatgtctcatttgcacctggaaaatcatagcaaactggttttaatgtccctgtttccaatatcatcagagcctgcatacttgttgtagtttactttttttcctacactcaagtttaaccgcatcaaaaatatagatcttgcttctaaaggtaatcttgaaactagacaggctttctctaaagtataatttcaggggcttggagctacttacttcctctccctcctgaactgattctctttctgctgtctatggtgccacaactagaaatacatttctccaggtttaaagctgaaccctcataactttccaagtagccttctagcaaaaaacaaacaaagaaacaaacaaacaaaaaactagagttttcttttttttaatatatttaagttggcttttagaaactggatggcagagtgttttatttggcaaacatagtacatttttaaaaatgaagttattatccacatttacacgttaggtttcaaacaaaaacttagatttccagtttctcataaaaaacagttgacgttgcaaccagaaattgcagcaaattcctctcacactcctgagtctttctaaaaggggctactttggagggaaataataatattttagacagttgaaagggaactatgtcactagatacaagaccatgtcagcctctcttaggagaaaatcacctttcttgtttcaggccttctgcccatctgcaaaaacactactgcttgtcttctttaataaatggaagcaatttaaagaaaacaatctataaaatgctacataagaccacattaaaactacaagtaaaaattgacatccaacaaaaccctgctttcaaatacaatttcttagaaagaaccttgattctgctgtatccaccacatctcgagtctatctccagggaaagtacaatagcgttaaaggtaacgggtagagactgttgccaagtcaatgaagcaaagactttctctctagatgcatggaaatgcacggtgatgggttgattaggtcaaggcatcttttgtattatgcatgtaaatgggaattaatgtcctcagagtgccagtagctattttgttgaatttggtaaaaatgaaaccctgtgtttaagcttcaattctctaaagtttatgttgggaggaagatgcaaaactctttatacttccataattaggtattcctttgctgacttatcaattgcctcaacttaggactcaaagtgcttagcgtcaaattgaaagagaacacatcttttattagaattgcttttggtttgtttcctctgataacaaggtaatatctgcaaaccagtgaatattgacactatttacaaccaaattataggaaaaagtcagtagggtatttaaagatgggattagtaatacctcatttacctaggcatttcctgggaaggagcaattctggataactgaattttctctgtacctgaagcttatgcccatttaaacctaaatattagatagaaatcttcataaaatatattaactgctacattcctgtcttcctacatagatacttctaaacataatactatcttttttttctcctgatgattcaggggtcatctctgtgagcattcattactgtaccatgtggttatatatttctatgcatgctttatcatttttttctctcctccctcaacgtcaggctttcagctgtcactttggctgtcactgtgtctcttctcagcttcccctttgctgtttctaatctgtcgtgggctgggaaaccagataaccaagtttattaagaatgacatgctgaataaaagtcagtaagactcagagtgggcactaagaaataaaatgcatgactttaatgtgcagtttttgtgaaaactattttgaatatgcagaggctttttaaatttaattttagattgggcaaccgcgttagggttgaggttgttgtgagaatttgtagaatatgtccccattcagtttcaaagtatttctctgcaggagaccaaggcagttttgacaaacacgggcaagagaagctaagttttccctttggaagcagaggaatctggtagggaaacactcaaggacactcatgtgaggctttaggcaactgtggagatcaaactcttctctctgatcaccagatatcctcttcttcatatcgagatggagggcattgcctgaaagaacgaaaatttagcactaataggtaaaatgtatggattcctgttagaatctctcagaattttaccttctcctttatagtagaatgttggctaggtgagatagaggtaatctgggaagggaaaagtccagaagtcactgtttttcccatgtattaatctacccacttcacttccatctctttctggacaatgcacaaatcagaaccctaacccaacgtttcttttcctgagactaatgctgtccctgaggatagtctatggggtccccaagtgcttgtggcatcctgggcctccccatatcaatacatcaccaccacctgttgttaaaacataggctcatgtattcacttgcttttattcgaatgacttaatcttcatggcctagcaacaaatagaaccctccctacagagccctccttatataccttattattgcatactcactctttttatgtcctctctcagtgcttctctcagtgctcattttaaaagaatttcacctctctaaaacagagtggtgcaggactgggtgggtagaagaaattgatttgttttgcctgcccctgtagccacagaatccagttacagccaggtttttgctgcaatcagtaaggatttctcatgttctaacaaagatgaaagcaataggagatagcatccgttatcttctcagggactttcttttcagtatgacaatgggcattttttgttgttgtttttgtttaaagccaacttacatgctgtacagcaagggcctccatcttccaaacactctaaagagtaaaattagtctgaaatccagtagaagaatactgattataccatcagtccaaaatcttcagggccaccagaaagtgccatgggcttgcggctgctaatcacttagtttggtgctttctaacaaggtgttgtctttcaggttttttgttgcatcacactaagctatgcttgcttcctccgaacacatttaagtggattctttttccaatctggagacttataaaaataaatatacatacccctttactactaatagtagggttttctgcaattggatctaagttctgggagcatgagtcaggggaatcaatttattctattttaggatatgcattgagatccacctcaaaaccttttaaatcaagattcaattaaatttaatatatgtaagtttgttatattaaaaaaacaaattgaaacaaaatatcactggagagacacaagaaaactgtacagtcctgtggtccttattttatctcttctttcagaaatgttggaagccaaactaaaattacaggcttgaaaagaaaaccagttttagaattccatcgccctcaaagatttcaacaatcaaaacaaaaccagttttataattccatcaccctcaaagatttcaattatcaccactacaaatcaatataggtaatcacttgcatacaccaagacaattttactctaaatgccatgtctatatacataactggactccatcctttaaattctctgtataaaaagacccagctcaaagttacattctctttgaagctatctggatttcccagatagaagtctttggtctatatttttaatctaagtttagcatggttgcttggtcttgcactgtcatgtgttgtaccacatgatcactcaataagctttaggtagcaaaagagggagttctttccatctctgtgttctccaaaagtgtctagaagatagtccaatgtaggaaacaaattatatttaagactgtcatacactgctttgtctaaaaaaggagttattttgaaatgagaaaacaaaagctaacaacttccaactttataagcccatttgaggcttcccatcagcttgtttttttttgcttatttgtgtgtgtgtgtgtgtgtgtgtgtgtgtgtgtgtgtgtgtgtgtgtttgagacggagtctcgctcttgtcacccaggctgcagtgcaatggtgcgatctcggctcactgcaacctctgcctctggggctcaagcaattctcttacctcagccctgggagtaggtgggattacaggtgcccgccactatgcttggctaatttttgtatttttagtagagagaaagtttcatcatgttagcaaggctggtctagacctcttgacatcaggtgatccgcctgccttagcttgtattttgaataacaactctaaacagaatgccgtgatgtcaacatttcattttcacatcaaattttaattcaaacccaactttccaacctgtaaaatttgctggtaggctggccaataatatgtacataacctgaaatgcaaaatatgatgaaaagcatagtgttataaaatagaatattccagacattcataaatatggatttgatggcccatactatgaatgattcagcacgcagacctttgaaattgtgatagtcctctttatgtacagaatgaaaaccatccagaggcaacaaaatgtcgaattctctaatccatcatatcatgaagccatcacagccttgcacatgagatttggttggtgggaatagaaaaacatttgcaagtctctggatttctctggctctttactcagagatgtcacatgcatccatgggtttgagaataagtgtaattgaagtgaactgcaatgtgtctctaataagtggctttgagaacatatatttgtgtaggcatatagtacatatctgtactgaagcactcttatcctaagtgtcatcttgtagcacagacctgatcaaactccgggattcaaaatgataatttatttggtataaatgacacaagccaaagaagataaaatatgttaagtacttctcttgattttctcttctccaaacacacacagatattaaataaaccactcccctcccggttcttttcctttaaccatgagaatcactgacccactgtgctctcagtattatccatgtgaaatatctgccccctcatcgggtacaacagattaaatgatgattaagctgagtgttaaatttaggatgttgtttcacaaaacctccctaccttgtagtgacatttttttctaaagacattttcttgtaatactccaaaagttaatgactgaattttagatggaggcatgacgtgaatctcaaatgaccataatttctttataggcaaattatatacagagttttcaaagacgtgaagagagttatgcatcgttgattttataccctaagtgatgattagaagtaaaatttcttagcttaaaagtaaacagaaaaataaaggaggtatctgacatggggaaagaaaatctcaggaacatagaactgggcttgcatactgtatagtacttgaaaaaccgttaagtggaaatgtatgatctcagaatagtgtttttaggcttaactctctgcgataacaggttcagactgacctggtatctcataagacattttgatagcaattcaaataaatgagattttttaaacattgaagttaaagaaatttttaaaactcttcaaatgcttatttttttaggaaggataaaatggtcttattttcatctgtggaaacaatacacatgagcagctttattctgaaatgccattgcaaagatttgtaatgcttttctattgttttacgatcagagttgctgcttttgcagtgcagaacaatgctgcattatatagaatcggcagattgaaccaagaaaacaaaagggagcactgggcaaccatccgttccttttaggactcttgccctcgccacatatcaccagatctctttagttagtcagtcttcttgtggccataacaaccccgagggctgactcggggatgcttccatagaaaatctctcattcactttctctctctgaactaaaactgtagcccaacagctcccattccctattctaagatgaatactaagactcatctgtgaagtcctttcaaatatacacaatttagcttatacgtatatacattaaagccaactccatggtagttatattcatctgaaaatcctttagtttatatcctgcactgattcaggctgtcttggggagatacgtctgtgtgtgaaaacaaaaaaatggcaaatgaattgacttgaggttataaacaaagatccgattctatctaatccttgctaatttcccctccttcttttattttccaagtaagcctagttaacaaagaaattttacagaaaaaaaaatgccttggtaaatattatctgaataatcctctataagaaaagcaggctctatttcataaatggaataaaatgcctttgaatatgattagagattgcatcattatgtcatcctgttttgagcatcattccttttttattttctagtggtttctattttattgttactttgtgataacacactaacatgctatgtgttgtatgttagcagtaatattatgtgcttgtttttagattgttctggatttatcttttcaaggtcaaaacatttcagtctgcttaagaagctactctgtggagatttttttttcataacttctatttctttttaattcccagacatgtttaaaattctaatcagagtgtgaaagccacattcaaatatgatataacacagagaatcaaaatcaatcatctaccacaactttatccctattttatgatccatcaacaaaaagctatttttgtaatctcgttagatttgccagcaataatgacctaagattaaaaattggggagggcttttttttcattttctctttttccccttgggtagtatgattcactctgtgggtactgcacttaaacaagtattcacaccccctctgatctgttcttgtcagctttttcatgttagtacaacaggaaagcaccccatcaatcattgtttcttcatctatcagtcaaaatgttcattttgtgactattggtcctgcatcccaatctgtgacaatctatgagtgtatatttaatttaaaaagagcaatgtgggaagacacaacactttaagtgaagtttgtaaatgagaagagctaaattatcagttactgtgtcaatgttattgatgggtggactagaaaaatacctactggatgcaaagtcgagaaacttactgtaagccctaccccagtcccctaaacccattttgctgctgaatgctgacacttgaatagtttctgataggccaaggtttttcgtatcacaaggagaaagtagatttaaaaggcaaaaatccaaaggagagaatacaaaaggaaaaatatagatcctgtgggcagattttggtagagtaattaacagaaacagagtgcttaatgccaatatgctaaatactaaatgctaaccgaataactataggaggtagactgaggtgccaagattggagactggtgtggtaaaggccagctccacttgacagtaagagtcggatgttaaacaacttgccatagctgcctcctgacttcttggaggtgtttttttagaatataactgtggtcctttggtccactatacctagggacttttggacttcctcctgcctacaattgcgtgcaaaggtcaaataaactggcaaggaacaaaatgtgagaccacaaatgcaaaaatggcacaactgcactactgaaataaatacgttgaatcaatgaactctgatatttctgcattaaaatgcagcttgcaaccactaactgcaaaggaaaatatgaagggaaaataaagagatggtaactaggacctaatatctatattactaactcaacttcagaaagttggtatattttcaaaattgcagatatgtctgcaacctaaagtatacttcatagcatttaattaattaattaattttgaagtttattttagaggcagaatctcactctgttgtccaggctgaagtgcagtggtgcaaccgtagcttattgcagcctgaaactcctggcatcatgtcccccttttacctcagcctcctgagtatctggaactataggtatccactaccatggtcggctaattgtttttattttttgtagaaatagggtcttcctatgctgtccaggatggtctcaaactcccggcctcaagggattctcttgccttggcctgccaaagcactgggattataagtgtgagctaccacgtccagcccatagcattttattttgaggtttagggactaacgtgtgtatgatttagcaagtgatgtttaatggcattttaaaataatgggtaccaaatagaaacgtatgaattgttacttgaatataattaaactttgtaaattaatggattagactagaaagaaaagattccagaaatttgaggggaaaaggtaggttctagcactgtctcttacatttacatattctgtctgtttgggcatgttattttatctttttgcatcggtttccctcttaatgtatgggtgaatatataatagttggaattaaaccataaatcagtcaacttctaagctgtatactataaaaaacatttgatgtaaataataaaactccttggaatctgtccctctttgtgtctccataaccttctatatttgttagttgaaataattatttctaagtctgaggattgtccattcaaggttgaacactcaagaaaactgatttatctctgttcatctctacaaagtcagaatcgaagaagcatcatatcctttggttaaattcaaggtagggaaaagaaaatcaaaccaattctaccaaagaacaaatcaattgatttgattatgagtaggtggaggttacattctttatcttactgaatttgaggtaaaatcggttaatccttttatccccaatattcatatttaatccagaaaatgctctctggaacaaaagtaatcattacaaaataaaggctttattctacattttagcaatagtctttccttggcttataaaaaattaattgcggggtattctcttgattgggtactttagatcctggtgactgttctaactgatggggctgaaagacagttcccttatctcatagccaaatcacctccatgcaaattgatctgggagtgcctttagaataaacacagctggattctctgcagccatttatgggtccagtttcctaggcttaattttgatttataactactgaaattaaattagccatcttcactgcttaagggtggctttgatttcaccagtgcagtagggagactatttaccaacatattttatcagtaacatttcaacctgggtaagggggtggcggtggggggaaggcatcttatctttggtatttgtacttgagattccttcagaatattttaattgtattatttaccgacaaatgtgaggattagattgtcaaatcagactcacatgaattaaagatcttgcccagcatcaagctttgctaaataatttcaaggatataagctatcaagttcagataaggtgcatcatataacataaagtggtgtaccttatgtcatatgctccaggtagccctgcctcatagatcctgggttctattaactatgggtaatcccttagccagagacatcttgctagggacagagatatagtctcttattcatagtaagtaacattagtctatttccatttgacaaagagattagactaagtctttgctttcctctaggagcacaaattattgtacaaaacgagaaacaaaatttgagagattaaaatatgtgaaatatgttaatagttctaagaaggcttttatctagaacacggtaataaatgtcgacgtgctatagtaggaagagttgaagataaatggttagatatcgctttttatccatatgactttgtgcattagttttttgagcctcagttttactaatattccaaaggattagggaaataagcctaaccagagtgactctgatttttttttttttttttttgagatggagcttcgctctttcactcaggctggagtgcagtggcacaatcttggctcactgcaacctctgccctccagcttcaagcgattcttctgtctcagcctcccaagcagctgggattacaggcgcccaccaccatgcttggctaatttttgtatttttagcagagatggggtttcaccatgttgggcaggctggtcttgaactcctgacctcaggtgatccatccgcctcagcctccgaaagtgctaggattacaggcaagagccaccacacccagtcgactatggaaattttaaaagacagtacatatacgtgtgtgtgtgtgtgtgtgtgtgtgtgtgtgtgtgtgtatgtatacacatatgctatatacacacacacacacacgtatatcacagaactgaagaccataaaatgttctatacatatgaaaaaatgagaatttgaaatgtacataattcttcacacagatagctgacagtgttataaatctcctttcttataaataagaaaaacagtctcagaagtaagtaatattctgatggagagttagaaaagaaaacctgtcttacaactctttaaacatgcttctcctctaagctaaatcatagtttgctaaagaaggtcgtgataaggtagaagaaagacaagaaaagccaaggcaatggggtgaagcaggcggagaaaactgtttatgcctcttcttccaatgtctatttattttctttgtggttctgagcaactatttcttcttttatcttgcaactgtcaaagcagctctctgtagagaaaccagcaagcacacccattaaaaccaaagcatgaattttcgggtgaggatcagtgaggctctcttaagaatacctgaattttcacagagataaacatatttatttgatttaaatggtagaaagtgttaattactaagtttcatatactaccaggagtcatagagaagtcattttggagaccaagagtatattcctagaccatgtaatcacatcatttgagtagctgcttactgagtttattcacaatgaaagcctgatacataaattctttaaacagaaaccagtggcattgttaatttccacttttgtttccaaattgttgcttttgtctcattgagagcatattacttacttcaagcaccttaacaaacaaagctgggtcatacacaaacgtcctactgtaccagcaataagacaatatgaataccctgcaacctctcaacaaccagaagacaaagatgtatttggaaggggcagatgggaagtgaaaaagagaaataaaatatactttacagggaatattttgcacacgtaattctgagtgttatatttttagcttgtataaataaacttcattagtcttcattttgaatatacaggaaaagtttttttagaaaagactcattgtcacaagctgataaggtaagttaggacagtatatgattaatatgctacaatgatgtctaagagagaggatgctcattaaatttgtgtgtgacaaaagttggaaagagtgttaagaccttgaaatactggagcatctttcaaagtgaaacttgacaagttagagaaatggtcagatagagaaatggattttaatcagactgaaaggaaaattaatgtattggttttgtcagttgtaccttcatcttgaacgtaatgactgcctgttacttcctctgtggtttcatccgaacctaacgcgacactcccctgaaaggtctcctctctcccttccttgctcttctgtagcccatgcttcacttctcaactatggtgatgttttgaagatgtgaattagattacatcattcttttcttcaaatcctcaaataatatttagaatataattcaaatcctgggttgccatggtctacaaggcctcaaataaaataggttctgcccacatctttgtttcattttctttcttttctctgcctccaggttggcacttttgttcctttaactcttcaatttaccttggtgctttgtaccagctgttcccccaaagtagacagctctccatagctcttcacacggctgcacttcctgctactctcacttaaagtcactgccttgagccaatttcgttaatctggctctaaataacaacacaaccccatctacactacagttcatcctaataccagtctaattttcttcataacacctatcattatctgaaatcatcttagttgtttcactttagaatcctccttctctcatgagaaagtaaacattgtgcgggcagggtcatggtcttgtttgtcctgtacttcccacccgtacagcagtgctggcacttagtaggtgctcagtagatattcgttgacagtataagacagaagtcctcaaatgttgtccaaggacatttggtagtccctgagactttcgggagggccaagggccaaaatctttttcatcatctcacaaatatacaacggtgctgtctagaggccaaaggatatatgctatcacaaaagattgcctgcagaagtagttgtgagaatctagctctcttaagccaaacatcaaagagattgtcaataatgtaaaataagtcactcttctcacaaaattatcttagtgttggaatataattatttttcataaaagtacacaatttattttaacatgcaacatgcaatgtggtggctattttaaaatgaattaataaatatataaatgttttctcagtcaattctcaatagagtaaacactaatacatatacataacctatacaacaaacataaacttctcagaggttttcaatacatttaaaaagtaaaaagggatcttgaatccaaaaatgtgaaaaccactgaaacagaatctcatcaactagtctccattattccctagaaaacatccagtagaactttcttctccagttaaaattgccctcaaagaaggttttctctttcctgatatccatgcttttgctattcattgtttatgaaatgtctgtctgtttctctctttctcatttctccatgtttgaagtacactttaaagctgtccaaagtagtcttttccatgaaatttgactcatagctctaccacaaaaagttctctctatatatacctttagagcattaagaacctatactaccaattgacaatagtattgttaattatcttctcaaagtgcctgtaaatctctctaaaggcagaaacctctctaaagacagagactgtcagacagtcatggtgcagcctgtatgtaccatgcaggaaacacaaaatgatagcaggatctagcctccaacaaactcttttctcttaaaacctagtatgggatgataaagattaaatggaaacaaaagcattggttagctatccacccaaaaattaatattctggcaatattcacaccttataacttttgggattcaccacccaaggtagacagaatcctcaccaccaccagcaaagaagtccaaatcctaatttccagatcctgtgaatatgtccttaagacgtaattaatgttatagatctagaaacagaggaatgatccaggattatctgagtggatcaactcattgcatgagttcttcaaagcaggagctttgtttggagcaggagagaagtggcagaaggggaagtcagagacatctgaagcatgagagggacttcacttcccactgcttgaagacagaggaaggggcacctggaaagcatgaaatggaatgagggcagcctccaaccaaaatccaggccccctgctgacagccaacaaggaaactggaccttaggcccacaaccagaagggagtgaatttagtcaaaaaacccgaatggcttgaagcagacttagcctcagaacttccagaaaggaacatggccctgccaacaccttgcctttggcccaagcagaggacctaccctagacacatgatactcagacttctgacctacagaagtgtgaaataataaatgtagtctgttataagccattgttggctatttttacagcaaccataggaaagtaataaagcactcatggcatgttcaattccaatagcccttgcagcagacacacaaaaccaccaacttcctctaagctccaagtactgcactctgtccactcaccctgctgccttctttaacttacaaattatgcacacagtaggtatgtttgcataattaaaagataagtagaagaactaatagtctttaaaaaaaattgttcctttagttgttctgaatatatgtttgtcctttgataaaggactctttgcaaggtttccgtatgacactttattcttaaaatttttgagcagttaatttaaaagtgaatccaaatggatatccaaatctaaagtcatctaaactgttagtagtgtcaaatgagattgctccaccacaagctccatttggaaaagtaaccagcacctgacctacagctgagttccatgtaatttagttgtcaaagtgatggagcacaactcttccatttaatttctatgacatctgtatcaacttgactgtatcctttgctgggccaatggcaatttttctggacaagatatggtgtaaatggcagggccaaaacacaggagaaaaaaaatgtaggtgaaattttaaaaataagataaaagatcacatgtttcctaggcatccaaaatttaaaccatctatttgatgatattaaactcaaagttgctgtgaccttattgtattagtaataatagcaccaaggtaacaagtccttggaatctttctatagcatagactattaactaggctctaataaaataccctattttgttcccactgcatgtcacttttgtagggcatatcttggagttaagaaataaagattgaccatatttattgatttgctcattctctttagagaaaaatgtgaggataagttttttatttgatacctagaccaatagatttccaaagagctgggatcaagatttttttttttttttgagacgcccggctaatttttgtatttttagtagagacggggtttcaccgtgttagccaggatggtctcagtctcctgacctcgtgatctgcccgcctcggcctccgaaagtgctgggattacaggcgtgagcaactgcgcccggccagggatcaagatttttaaaatctcttaaattgtccgaagggtgcttcttccactacatcatagacagaaataaaatttagttctagttagacaccctgctctttgaaattaaaaaataactacattaaagtaggcctttccttccactgataaaatgttccaaagttatttatcacaccttgtctattacatttttgaacagataatatttctactatctaattttttaaagcataaaaatatacagagaaaagtttcaatctcatcatctctgtctcttatctgtccagttacctgcactcccacaaacccgtctaaaacaactattgtcattattattattatattgactcttccagagttgcttttggcatatacaaacagtattattattactgtattttatctcacacttttggtaacatactttacagacaattcttttcacagaaggctagcaagtcttacggccatttgacagattaaagcatcaaggctcaggaaaattaaaccttttgcctacatatatactgacacttgagagtcttgcatttttctgaatggtattctatttctatcataccttattacctctgttagcacatgattacctaccatcatttattattctctgtcagcgtcctgcatataaatccccatcacaagggactgaaaggatcttagaattcatttaatcttctactcattcagtatttgcatcacatggtaactcccattcctcttcaatgcttggatacctccagtaagttgtaagccctttaaggatgggagacattttctgctattgttttccctctgttataatttatcatctactcttttctctcttctatcaggataattataatggcataatcccttttatgtgacttcccagtcacagttagttttttactataagaataatttgtaaccagtccctcataggatctcagtgcttgtccattgttgctttttcgtatatttgataaatattcaatttagaataatcattggtaataacttctgtatctttacaaactaatgactgaaaataatcattataatgtaagactcctttaattgggtttccaaaaagattgtttcataggaaataagacctacaggtattcgaaggaaaaaataaaagcattacatggtcaggtaagtaggattattagatattcttagaaattcaccgtgtccattattatgtacaaagctcagagaagtggatataactttgtttaaaccagagttttctaaacatattttcacattgaactccttttccagataacatagatgagcatcctacaggccattttcatgaaccatactatggggaaaaacgttgcaaaagaccatttgtttttaaaaatgttgtaatgaaaaaaaaaaacaaaacaaaacctcatttgtattcagcatatgtaaaacacagaagagaaagcatatctgaaagaatgacaaatagctcagttctcttttccaagcttcacaaagctacatagttcatcttctcaatataactcaaagaagaacagagaaaattttctgtatgcacataaatgtattcatagcatttttttgaatttataatgccttggccgccacatctcagactgaagaattaaaaacaacagtatttcatacttttcttgatttttttaaacttctcttagccaaagaaatcatacattgctgtacttacattgtatgattatttgttattttagataactcctcagataaattcactaaattaaaacactgtatcgaatatgttttgcttttttgtctggacagtctttttattgcaacatataatgtaaaaagtaatatttattcattgtcactgttataattatttctctgattttaaaaacagtaacagacaagttttttttcccccaggattctccattatatctaactgaattcccctatcaggatgccctttttgttttgttctgcttccccctttataataggatataaacaagagacagaagttaaatctccagtgagagaaaagtaacacctaacgaacagacaaacaaacacaaaaactggtgacagtctcaacattctcaaatgttttgctcaagcactctattactgttagtattgctcatttcatttaattgtaaataaggtagattttgctgctaagcaaaatgatagaagctagatcttcctaaggacaaacagttataagaacatctgtacctgagggcaaaccaccagaaaaagcaagaaaaactcctaatagtgagacagaatgagggaaaggggagaaagactaaaatgtacctgccaagaaaatggcatatgtttaacagatccaggtaactcttttttgatgattgcagtaacagataaatgcagactgacctctgcaccaggtatttctagatatccagatggcactcaagggaagggagcaaccttagcttaaaagttttatttcagaaggtggtggagggttaagaagaaggaaaggtaaagatgtgtcaacatcatcttctacaaggcttgttcatatgttatagtccatttgagaaaggttcatttaaagtatgttttggtgatcaatggttgcccaaataggccctgcctcagtagagaaacccatggagtgccataaagggcatcaaggatagacccaacataaaagactacttacagtaatttaatagcaacttaattcagatcagagctgtgcaataatgaggaacggttaactatgaattgatgtttattgtatgttagaatttgagctaagaatttaacatggattatagattacccacttaattaatcctatagacaatcctgtgagattcattatactaactcattttccaggttagaaaattgaaacagactgaataagaaacttgcctaaagtcatatcgtttctacgtggtaaaggcaagattcatatccagagctgggcattttaagtttactgtagaataaaataaaataaaagcacaattcaaaatatattaaaatatatctaggggagccagctctgagtttaacttacatcacttctggtggattgaatggatttcagtggtcactcagctatattatatataagtaggaaattttctaggtatggaaatatataaactggatcagattctagaagacagctggtggccaatattatctttattattctctactgatagaatagtatgcatcctcttatatcaacagagaagaaagattataaaagattgatactaatccaaatatagtttttttaaattgtttccaagcttgtcctcttgctggttcacaattgggtcaagcacaatttttaaaaatatatattattcatctttaggcaaagtttccttacaattcttaaatcaaagggagtaggaagtttgcattacctaagaaaatagaaataaaagaaaaaatgaacatggaacagattactatttcaatatgctgcaggatatttgcaaaaatatttaaaagagagttacttttctaaagcattaatttagaagctaaaaatctgaaaattgaattgataaataatggtttcattttaagaaagatcttaaaatgttatatgagaaaattaggtcatatcactttttttttttaacattgttagtcttcaggatttttggcataatttatatgtgtaaatttatgtttttgtcttatattaatattttagggctctgtgtttcatttctttcattttactgctttccttgatctcattacttatgattaattagaatttttcaaaacctaacctggcacaaataaataccaatgaaagaaataagaaaatattggcccttctatcacaattaatgtagcatattaataatatataatattacaatttacaatagtttctaaatataaatttcctcatatttttctcacgaaaacctgtgagttaaataaggcaggaattattattgtcattttactgataaataaactgatctttcaagaagtaaaattacttgcctaaagttatgcagcttaataacttacgaataaaacatttgtttacaatatatacacagaaacacaaacacacacacacacacacacacacacacccatccccaggaactgccgatttctagcataaatctactgtaactcagaactgaattaataattatctagtttgctgataagttgacattttgacaaatgtgtctcagtataagaggaaaccatacaaagatgaatgtatttacaagtttatttgaatcataatacgaatgggcttaacttccaattctttattcaattggtccatattttatcaattttatttaaacaaataaatgggtacgattctattgctttcaatagataaaactgaatcagactgatggtatcaataattatgttaaacctatcaaagtatttgagggctttgtggtagaagttaaatgtgataatccacggaagcacttagcaagtgcctggtatacagtaagtgctccacaattatgtgagtaacatgctgctttataactaatcacaaagaagtgatctggcactatgaataagatatatcttgactttcataattttagattactggataatctcctgaccaatgcagttggattatttccaacctcccacatacaatgtttttcttgaataattcagtgggaaataaaggagataaatgaagtctcagaaaatcagttgcagcttcaacctcattttgacatttccttctaagtacttccatccacacaagtgaaatgctgttgctgcccccagagacaccgctgatgagcccatgcttgtcacctaattcaggaattgcccttatgttgattggcctatggcccatagtgcgaccacacataaaagatctgcacagacaggaatagtggtaataaacaaaaacaatcagaggctctcctacaaattctaattagagataaaggagtcagtaagtagtacaaagaaaagcacaaaaatcacatatggagaaaagaggcaaactgagtaaagttactcagcagtagactagtagaacagtgattcacaaactctgccatggatccccgtcaagcttccaagtgctaaacttcattctggtgtctactagacattgctatcatgaggttcttgttctctcttgagctcttaatcatgtagctattttacaaaaactatggttactgccttctttacatctttgtcaatccttcaaaagcatttccattatttaagtaatgtaagtgaactctcaacaaaacagtctactaactccagggtactttttgatacatatacctgctgggttatatagtcattgcctgttctgagtttgagaagacggttaagacaataatcacatcacgcatgagatacattctagtatattttatacaacaggttagcaaatacttctgttaatggcagggagactgttactttagtaaataacctgagcttattgataagggaaacttgatagcaattggagaattagaattagaattagaatctctaattctccaactggtaaatgactcctctaaatagtttattcaagatgaacattggctttacaagaaatcttcacagccaataaagtagacactagctgtggtttataaaagctgaaaacactattaaatatttcagttctctctgatagtgttatatttgactctacttagccaaacatgtcaatttcataagaaatctataaaatgttattgttaaatgggaatcttatcaatgaccggtgcatttttaatttcaatatgatagcagaaggcaaccaatataagtcatatgaaaagacatatttggattttttttttttttttgctacaaggcaagggtcatctgaaacatttcccatttcatattttgacaatttatccttcattgtttaacataaagccttctagttttccttgtttcataaaatttgaacaatcatgaggtggtagtagcccatttatctcatggtaaatttcaaatgaacttacacatggtttagatgggtttaaagtggcagctgtaatttttgttgggtatatgcagctgtctgtaatgattctggtcatacattttcattcaccttattgtctgaatattttctaaaggaaaataggtgtgtatgtatttgcttggcccaactttgatatgtcttgctggctttcatcacctttggaagaaattgcatttcccagtaagctgttccacagtggaatgataagtgatgaccatcctgtggattttcacagctgtacaaaagacattcaggtgcacttgtcttttgaatcagaacccagttagcccctcgcacatttacaaaattgcttttgggagagtcaaacctggatgacttccaagctagttaaaaataattctgaagaaaagtgcagtgctggttcttggcggtagaaatgtgagttatgttcagctgcagtagattcctttcaggcagttctgatacccatttcaacttccaaatttctggcagacgttatcttgtactttcagcttttttgtgataaacatattgaaaattcagtcaaacagctttttatcatttcaaaacttgagctcaaatttaatcctgctgccctgatgaagcctgggaagctgctagggcattttcattatatccagactggactgcagaactccttgccattcttcaggactctgacagcatcattcatttagaacaatgtgatcgatccagaagaagccagcagcaacaaactctgggtactcatacggaagagcatatcctatctagttgaaaaatgtttccgtcttcattcttagcctagagataaaatatcccatcatttggactttagatcctagaagatcttacagattttcctacagtatattaacagtgtttacatttaaatctcaatcgttagctacagatggataatctccaaccaacaatgttagagttgtctatcattaatacatttcctatttgtaaaaatgtggattgctaactgaacattttgtttcttataaagatttcaggtattatatagaagtaacctactaatctttgatatatgtaggaatagaatactcattagtgttttaggactaacctaagaaaattacgagttcctaagctggccaacactcaagattagaactgatataaatgaatctgaaagttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttgttgttgctgctgggaacagggcttgagttttcactgctagagcctcgttagtaagataaaggacttaaagtacctggtaaaaggcaagctgcacagtttaagagaagtttcttgaccttgaattgttgtcctcaacaacaggcagggtacctaagttacacagagggaagacttattttcccataaaacagggtacccttacctaagacaacccaataaagtgtgatgggaaataggacctcacacaggaggagaaagcaaatctaaggtgtaaagtatcggtgggatctagtctgcttctctccattcctcattctagctgtgcatccttttcccactttttcttttcttgaaactactcatgtaaggagccagagcagggatccagggtgacagtgaagaaaccctaggctacagaagcctgaatcaagaccactgtgtgagcttccagccatagctcaatccaggcactcagatcaggaacaagcctgttggtgctttggccattggcattcactgaggagaacagggttctatgcagacatttgattgcctgctgatttctaacagggactgtcctctgttcatggctttccaagagccagcctttatgggagcctctcagaggtgacaaggtcagtatgggcccctcctcacagcactgatgcctcacagatggcatcagctcgtaccacaggcaaccacatgagcttacttgttgaggaatgagcttggtattggtggatggcacgtgatatttgcacacatttattcaacaaatacttattgaacacctgttatatgcttgctaggtactgagatgaaacccggaaccatacattgactctatctttatggggtttacattctagcaggaaaaatatattaagtgtacagttaccaaaaattaccaacaattatgataagtacagtgaaatagaaatacacagtgttatgagacattatagcaggaggatctaatctactctggagcatcagaaacggcttctcagaggaagtagcttgtgaagtttgacaagggtggccatataacctatcatccaaactgaatcacttcagagaaggtaccactttagaaagagggtgccattaacaagtacccacaggataacaggcaccaagaaggatttggttacctgagatatgacctgaaggaataaaatcaggaagaccaagaggaatctgaaaatacccgaaatctgcttctcatggctgggactgttgttttgaactgatcctggcagacttttggcccactgagtgaggactgttgttctatgcttaaggaatgaactattcattggttcaagtctaaaatgttagaactttggctcatattaaattacttgaccattcttagaaggaggccaacacttgacatatcagaacattcctctaagatcacaaggctatcaagaattcaattagaatgaaggtcctttattggcccagttccccagaaatgcattccagaagatatattttgagttgatacatgtaagactctactattactgctcaatgagtgagaaaagagatctagaggtatctgaattgttgactagaaagcatccaccagaacatgtgcaatgaataaacaagattttcctatataaagaaaggttgagagcagataaaattgttcgcttgcaactttacattgtgggtgaacagggagctttcaaaggagctgcagacttgtattaccactgaaggtaattcaactgtcgaccacacgccaggaaagaacctcttaaacagataataagtattcctgataactgccaaagggccttgatatttcagcaagctgcaaaagaaaataaatttaaaaactcacatcttactcaggtaatgcattaactccagatcactacagagaacatttcaattcccacttctataaatatacacctgttcttcatttgtgaggcacccctaacaacacacatacccacctctatgcacagagaggatcttataaacattattcttgctttccttgtacttgggtttgatttctctatttttcagcaagctattagatgtcattaatactccctataatttcaatagtttgttcttttggactaggttcaggcattgaagttaatgtcaaattgacattttttagcctaaacatacttttcccatctttgaataagttaagaataagcattaaaaagtgtcaaaaataaatgaactcgacatttagcttacatatagtaaaaaggtatatcaattatttgctggtaagtgagcacacagggcagagctgataaacatctaactttaagtttgcttctctgctttttttggcaaggaaagagaaaatctttatttgactacagttactttggttttcaacttttaaactagttttttgatatgccaaattcaacacatctttagaccttattaactacctttctgtttgcaactgtatctaacatgttaaattacaaccaggtgcagtaaaaccttaaaaaaatttacctctgtggcccccataatagaaaagaatatttactgactcttctgaacattggaataatgacaacaagcaaacagaattaatataaaatagaaacttctgtgtacttactggtcaagtcagcttaaaattaagctcttgcactcttaacccttaacccttaacaaccctgcgtagcaaacactagtctctactgcaaggctctatctaaaccagtggctgtcagttttggtaagtttaagcattggatggaatgtttattgaaaaaccacattcccaggacccacacccttaaggtctgaaacagccctcaggaatctgcactttcatctgtttaggtgactttgaaatgatagttcaggtactggactttttttttttttttttttttttgagacagagttttgctcttgttgtccaggctggagtgcaatggcacaatcttggctcactgcaacctccgcctcccaggttcaagtgattctcctgtctcagcctcctgagtagctgggattacaggcacatgttaccacacctgactaatttatgtatttttagtagagacaggttttcatcatattggtcagggtggtcttgaactcctgacctcagatgatccagtcacctcggcctcccaaagtgctgggattacaggcataagccaccgcacctgggctcaggtaatggactttgagtatcactgactgctatggttttaatatgtctccaaaactcatgcattagaaacttaaccccgaatgcaacagtgttgggaggtggggcatactgggaggtatttaggttatgaaggtggaactctcataaaggaattagtgcctctttataacgggcctctggaagtggtttctctcttttttgctcttctgccatgttgagtacataacattcatgcccttccactgccactgagtgaggcaagaagcccatcaccagacaccagacgccggcaccttgatcttggacgtgccagtccccagagctgtgagaaataattttctgttcatataaattacccagtttataatattttgtcacagcagcacaaaacagaccaggatcctgacctacattatttcaagtaggaaagataattgtattcttcttaatacttacatctagacacatgctaagtgctatatattatgttaaatcatttaatcttcacaaagatgccatttatgaaatattattgattacattttacagattcagagagtttaataaactgttcaacacattataaacatcaggttccaagtaagaggtgtcagttagattctaaagtcttccctttcctttccaatgctgtatctccgtatatcaaagcaacataattaattgctattttttaaaaaaaattgttcaagcacaaacttacattacaaaacctttcagattcttcagatttaataaataaaatcattcctttcaccaagctctcctgtatcagtgtaatagcagctcagactcttgcccagtggtcaacttctcagctaatcaaagatcttggtttaatgtaggccaaaccaggtcccctgtgtccttatatatccttttgcacttttcaggctttttagatacgttatctcattttattcttctaacggcactaatagatcacacaaaatagatgccatctttgtctgttaataccaaaaatcacaacagggttctcactttgctcctaattcagaagcatcatcatctcagccctttaactctcatatgcagaatttatttgagctgctcccctgccctgtgagcttggcagctttgtgtccctgtgtaacctcatgactgcagccttcatcccagggtgccaacctactcagccaaagatgacattaacagaggatctggctgaaatgccttgacattatttttctctgggaaaggtgtgtaattgcagaaaaactgctccccaattattcaaatttaaacattttatctgatggaaatgatatcatttacatattttgtttcccagtttaaaattgtggtttcatatcttttgtgcttgtatatctgagagttatattaaatttaaaatagctgagtgtattggctcactcctgtaatctcagcagtttgaaaggccaaggcaggaagatcacttgaggccaggattttgagaccagcctggtcaaaatgacaaaaccccatctctactaaaaatacaaaaaattattcaggcgtggtggcgcatgcctgtaatctcagctgcttgtgaggctgaagcactggaatgacttgaacctgggaagcagaggttgcagtgagccgagatagtacccctacactccagcctgagtgacagagtgagactctgtctcaaaaaaaaaaaagaaaaaaaaattacaatggctagccctggatccatttggtaacaatctcattctaatgtatatctttacacagggcaaattttaccagaagccttttaacgataacattttacgaattcaaaagagcctagatctggcaagtgcttggctggcagaagtgaaatgtatggtgtgttcaagaagcatcaattatggctgactgactggaccctgagttaaaagtcagcatggagagagaaaaaaataaatcatcctacgcctttcaaatacacattgtaatgtcccttctacttccacttgacaaatctataaggaaatataggttggggagcatgtgtatgtgtccaaatgtacttcgcaaacaaaaaaaaacagataaattattacatcattaattaacagtggtatttaccaaaacacataacatcttatgtcaatttaaagacctgttggtctattgaggagtagtttgtaactagctaagttcattgataagctaaaatcaaatgtcataggatcctggtcttctttgaaagattgcaatagaaatacaatgtgatgggatttttatatgtttattataacccagatgtacagtaaatcagagcattgctgaatttaaattataccatcacatcctcaacaacgatataaatattgaaggaacagagagataagcaagctatatgaccaatatctaacaataaataggtattaggcttttactttaaaaattaagggcaaattatttaaaatattagaaaaggtagcaagatacttgataaagaatagtgtgaactgacgtctgtcttccacatccctgcccattaccattcccagtagctaaatcaactttagtcaaggttaactaactcctttatatggccacacaggagtcccttggctatacaatttgcactttaatcctctggaagttgcaagaggccaaatgaaatcctcacattcagccagagggaggagagaagaaagccataattcagacctccctgtaatatattaagagaaatctgtcttttttttcagtgtcattgccttggaaggtaaccccttcttgaccctagcatttaaaagctaggttggtgcatgtccaacatcagggtcacagccatttttctgctactcagttcatcttggaactgaaagatagtttcttcccgccatcaatcattacccaaggtaagtgtcacagtatatgggtgcataaggtaaaaacagatgaatattaattggttcattttatagcaccaagtacaatgaacaaaaggcctggagctcagagttggaaactgaaagtttccaggaagaatcaaaatataccaaattctcaatagctatttccttatcttctgacgtgtgctaaattgtactaccaaatgtcaaatatgctgagtagccttggaaacaggctgcaattgtgaactgttagtctaccagagagtcaggatccctagctccatcaccagtatgagcaggataatgggcagatcattctgtttgctttcatctgttaaacataggtagtaacacctagtatatttacagcacagatacattagaataattcagtataaaaagtgtaaaatcagctggaaaaagttaaaagtgctatttaattataatgttatgatgacaaagaatgtgacccataacatccccaaagaaatttaggttaaatttaatatgtggactgtttactggtaaacatggtagaatcatgaataagccattattctatggaaaacaatgcaaaaatttatattaacttcttttactcaaagggtactctttctgtcatccactcaaatagtactgtctagccagaaatgagtttatttttaacactatacaggaaatagcacctcacatatatgtcagtttcagtcatgtggtcatgattaatagtcatcatctgataggcagggtggaatggtgatgtgaacatgggatttcgggttatccctggatccacatctgtattctggtgctttctagttgtgtgacattggggaaccttccactacttgaccttcagtttctattgcctgtgattgtaataaaaatgcttctcacagggttgctgtaaagattaaataagaaactggatgtaaaagtgatttgtaaactgtaaattgtttataaatattgttattatttctatatggatatagagggctcataaatatgccgtctatttctggaaatttaaataacttgtgtaagtttttgtctccaacctaatttcccagatatctttaaatacttctcacaatgaatttccattctactcactgaaagtgaagtcatcgtcccccatcttgtgcattcttgcctttttgcttagtttgcatgcaacactctctcttcctatatctacatgaaaaattcttgatgatcttctctatccatcctttaagtcccaactcaaatgccacttcctctctgaagccctcgctgattattagtttccatatattaatctccatatattgatctcttttctaatccttttgttgcttgaactctcaacgcacttctttttgctgccactcatttaccatttaccatatacacattctttttcacagttatcttttcaaacaaagtttatacatcttatctctaccattagaatacaaggtccttgagattaaagaacatgagttagacctttctagtcccaacaaatctagggaggtgtcttataagcagtagtaaatgtgtgtgatgactgatataaatgaagtaaatgaaaatgtaatgactaatataaaaattggcacaaacatctattccatgcaacaggaagatgttttcaaaaataatattacattccaaaatgattttccagtggcaatttgcatagtgtgccatttcagtgcacatgtttaacagaattagcagaagagagactgatataagacaacccattttaggatttagaaggctaccacagattaaaaactaaaccaatttctgttcacaggggagaaacatttaggaagccgcaatctacagtaactttgggaggaatctgtccattattgactaaattaaaacatgagtcattgaagaaaaagaataaactcaagcaactggctaagtaataatgaaaaataaaataataaaacttggctgaaaaaagataattacagtccacatttcaaataagaaattataaaataaaaacaaataaaacaaattaccttacataagcaagtgatccccatctgccagctcatttgctatgataatgagaacttgttgcattctagttacctaaattatcatatctacttccatctacatataaatatacatctcaatgtaatggaaaagaaatggtttattcaattactggatttccggagctaacaattgttacaatttagttaagtgtcagacaccatgctaggcatctttacaaacaatttatttttaatcctttcaatagtaatcttttgaactccttaactgcttatctcctttatcattaatttaacaataattcctataatattttatgatgtctcttctattagttgctagaactactattctgctctctttctgccatttgttcattcatttattcattatggctaaatacttatttattggctattacatgcaaagtaccatttttagctctaaacaaagagtagtggaaaaagtccattacccaatggagccttcatgttgttactcaattctgtgcactgtgtagtcaaactagattgttagtttcttggaagctatttatttaatttgatttctttgtatcctctggtgtctagtacagtaagtacttaattcaaattggcatgcaatacatatatgttacttcattttaacatgttttaaatattattggattaaatgacatttattcctctactttaaacattataataacactacatcaaattctaattatcaagggaggactcagaggaaagtctaataagccattattcatcacactacatgtacttcctggtaccccaaaagcttgtccccattgaaacacaattattaatgcagattgccaggttgggtttctgttctagttggaacaacatctgtgtttgtaatggccataatgtagctaactgtgaatttttaccatgattttcagtaacagaataaacattctcttgacatttctacacgacaagactatgaaggctatttttaaagtattttgataagatttggcatttgaaaatacgaactcaatttaatatgaaatggacgaatttcacttacaattatagttttaatctgagctgctataacaaaagtagctcaaactgggtgacttaaaccacaaacatttacttctcacagtacaggatgctgaagggtccaaggtcaaggtgccagcagatttcacatctggtgaaggcccacttccaggttcacaggtggcactctttttactgtgccattgcatggcagcagtgacaagggagacctctggggtctcttttgtaagagacccttttgtaaagggactcttttgtaagggaatcacattcatgagggtttcactctcatgatcgaatcacctactaaaggtctcacctgaatatacattgagggttaggatttccacaaatgaattgggaaggcggaataaacatttagtgcactacaacagtttatatgcccactgttctcttcacttttctcagccagacagaagctagggtaatatttttaattcctggtgtccataacgtcagcaattacccgatgttgttttcttcatcacgctttgaaaggcagcacagcataggttaaatgcatggtttttgagccatggtttcagataaaaaataggttcctctctttgggacttttatgagacttattttatacaaacacatataaacatgggtatgttgttatataaatcttgggcataagtgcatgagtatgggagcacaaaaaaaatttggcttagccacattaccgttaaagaaagttggatgtggatcgacacaaataacatgaaggctgggagctgggaagggaaggcatgtttgcagagtaaagaaagatgaagccattctgttctcaaaaatcaaacatgtaaactgtttacagttatatttaatcccccaaaacaacatagttattaatctgtatctgtttatatcacacataaagaaaccagaaacagaaagttttactaatgtactcaagttcatatgatgatttaattcaggatttgacaatgagtacaaagctagatggccaaccaaggacgctcactaattgcagtatgaggaaaataagagcccttctgcagagtttccagctcaaaagcttttaagagacaagccctttgtatgtgtataaagatgtgtgtttgcattcatgtgcctgcgtgtgtgtgaaataaaaatttcatacttgagagaactatggaaaatagcacagtaactcaacagagccattgacatttgatattcttccttccctcccttcctctctccctctcatcctccatctcttctcccttctttctttctttatcactaagctgattagataaaacagaccatttcaaacctctgctttaggatgcgttgcaaatatgttagtttgcatatataaaactaatatataaaagtaaatataaaaatatatttataaatatattcataaatacataatataaaagtaaatattaaaatcctacaacttccaccattgtgaatgcactaaaacacattcaaagaattaaaaatttggaggcttggaggtgtaagattagagacttgtaatctttatccttcaactatcacacatgtttgactatcatatttgagttgtcttcatccctcaactattattattttctgttcattaaacctcttaccataattccagtttaataatccatgcaatggtttgaatgtgggggaaaataatattgtttggtcagtatcatcagtatattcaagcaaaaaattaaaaaaaaaaacaagtatttctatttcaaaataaatatcttatttaaaataagtttcgttttccggctgggtgcggtggctcatggaacctgtaatcccagcactttgggaggccgaggcaagtggatcatgaggtcaggagttcgagaccagcctggccaacatagtgaaatcctgcctctactaaaaatacaaaaaattagccatgcatggtggcatacgcctgtaatcccagctacttgggaggctgaggcaggagaatcgcttgaaccggggaggcggaggttgcagtgagccaagatcacaccattgcactccagcccaggcgacagtgcaagactctgtctaaaaaaaacaaaaacaacaacaacaacaataacaacaatcatttttcattggatttattcttgattgggattattagcataaaagtatctgagaaattgcacataactcaatttctaggtctttatctctctcatcctgaaaggcttccttaggccaactttgcctacttaaatgctttccttatttcaagaccctgttcattcagtggctttcctgaagtctctctgtcatcccaaatacactgcttggagcaacagaaaaggtaaagctgagagagccatcaactatgcccacagtagccctcagacgtgtacaaatacacacagatacatgtttaaagaacaaattacaaaactggtcaatcattaaactcagggtaacacattttcagcctgcacaagatacctagatgtttggctcatgcctttgctgtagatctgtccagcaagtggtctgatttttggatcagaacatgcaatttctgtataactgacacacagatatatatattgtctttcaactttttttttttaaccacatcttgaaccttggaggagttacaatgggaaacttcattttcgaaactcccacaagtaaaatagtgcaaaattcatataaaaccagttacaacatgtctctttcagggtacctccctccctccaatgtaagctacaaatcagccacattaacaaaggtcgcgctgcatcttccagttaatttgaactctttccctatttgcttccatctgtgagcaaacaaaacatctccagtccttaaggggcgcctccccagcattagctgctacttttatgccatactgttggtatggtagctaggaaaaaaatgcagtgcctgaaacaggtatttgcattcctatctacatcaaagggctgaatttttctttcatgggacttagtgttttccagaacacaaaagatccatgcttagccacaatattacattttgcatttataaaccactcttcccagtttctctgagatctcctgcatgtccaaagacactcaagcacttcaccaaagagattctctgttcctgttatcaagtattttaatacaagataacaattacagtttagagaaatgctagaaaaatgcacggaaagctcccaggtgccacttaactctccttccttgctgcattccctctcccaccccatcactgaaacctgagccagccaattagatgaacagcttgtcactcctagatgcagtgcaatgtctgcatcttactgcagctgttaggactgacaattcaattccagtctgcaatcctacaacaaagactctctcgtctggttcctgggagtcagagattctccttgttcatctttgaacctcaaaaatatggatttatcctggagcactcagaaggcttaaatctgtataaatagatagaaacatggaaattgtgaccctagtttagccactagatgactcagctggagtggactcttcggcttccaaggacagctcacatagctgctctctcagaatataccttaaattcccaatcacagagcagggtgccctaagaaccattcaatttccctaggcctgtgaacagcagatttttgccttggcaggttggataatctacaacactctttcatatgtctgtcctgttataaaatcagctctagtttgtactgggctctagaaagcattagagctaagaacaggatcctgaagcatgtatttcagagataactaccctttactaacaacaaatatgtagcatacagattcctctgaggtgcagtaaccacttttgtatttatagttattaaaagaagggaaaacaagaaatcaagggccacctcatttctcatataatgtgttctcctttgtgcctgacagacagacgaggactacatgaagcatgaatcctcaggatacccagtcactaattttttaaagtggaatgagtcctaagtgtcaaggggttttaagtaaagtgaaaattaaagcagttaaaaggaagttatacttaccacttgctatttactggaccttgtggtatgttttttttcatacattattttattttacttcataaaacccaattaattttttcctcataaacatttgggatagatatttttactcatattttacaggtagagaaagttgatatacattaatatgggtgttagtatctgagagaggttaaacaacttcccgaaactagtgagtagcagagctgaaattaaaaacctcaactactacacaccagaattatttaacagagttgaattgtgatttttgcatttctcgggaaatgtcccttggtgaaaactctgagaagagaaaaatgtctgaatttcttctgcaggaggtctctaggctcccactgctctttaaaaatggtgatcataatataagggatatacgtccaatgaatctagtattccatagactctatcaatcttttgcccaatctttgctattcttcaaaattttctgaagctataatttgggcatctccctatcatttactgcattatttctaggctagatgttagtggcaaaataattaaaaaatatggaaccccaaaattgagggtcttcacagcaaaaggaggtgataaacatacaattccccataatacaattaattctgatatatcagcactatgagcagagtactaagagatcataaaggaagaagtaatagcaaattgaaaacaatctaaatcagcaataaaatattggtcaggttaattatgatatatccacacaatggaataccacatagccattaaaatcatattgcagcagaatatttaatgatttggggatacgtttcatatacattgtttagtagacaagcaggctgtaaaataaaagcaatataatttcatttaaaaatatattggaagagtgagaacactttagcaaatgttaataatggttatattaatataaaaaggttaccattattgcttctgctttttgcttttttatgttttgtatagtgaatatgcttttcttttgtaattagaaaaacattcaatacagtttaaaactcaaatcatgttaacaaagacttaacaacaacaaaaatcaatttgaaattctttcgaattggggaaagtaaaattcctaacacacttaagatttatttccacagatggcctcatgagctacaaatacctcactcataaatcgtcttgccttgaatttccactcagtgttctgatatcatgccagatgtgggatcttgccttggtccaactcctcctttgtaattttaaaggcctctcacacttgggatgctgagctagagtcattctcctgcttggtagcttttgagagtgaacagatcacttcgctgtgtattgtcattcagttagtagatgtttctggctgcttcttcaacccatacaatatacctttcctaccaagaaatgtgtgacttctattctctcagccttggtgtaaatccctgaaagtgttaaggagaaaaaaagagcaagaatcctccaagatctataattgcacaggccccaggaaagaagcataaagaaaacagtaactaaaaacaaatgcagaataagacctgaaatacaatatttgaccacagtctaaaagtaaaagcttagaaactggtcaaggatgtcatgtgtcttgtcggttttgaagaactattattcaaagctttccatttaattatggccaaaatgcccaggtctgtttttcttcaaaatccagtgttctgatgactagctacattacccatgcatcttgagatatgctactgggaaaagaggaagaacagtttaaattattgttatgtggaaagtcgggattattaacaaccaacgaatctaggaggaaagccaaaatctgtgaagaaggctttcaatgcctctgggccagctcatctgaattcaagaactggagaaagattttcacttataaagttacccagagggcctggggaagaggtgagtgtcttccagcagctgagcatagatcagtacctgagatcatttacaacctgcatggctgtggtcagaccctaatgcagcctgggctgcagacacaacgtggtcagggtaccaacaggagactcagtgaaaaaggagactgtttctggagaggcctctgaatgatcagctgcataccaaccactgtgttttcgggtttgtttgtgtgcgtgtgtgtgtttcctagtgtgcactgaaaaacatcctaatttatacatgctcatatatcaccagcttgttaattcaacactaaagcaaaaagatgacaggaatacaagttcttgcttcattttttctgttttctctctaatttgtttggtagatgaatggagcatgcacaacatttcagatgtttactcaaatacaagatccattgtgatgatctttattacttttgtaatactaaaacccacagttgtgcttaatcataagatcctctagggtgacactctctaaattaaactaccaagaatttatattttaagtcaagctgtctcctgggtcttaatagtatctgatccagaaaagaaaaaatgagtgttaatagcagggcatacagtactatataaggtgctttaatcatcctaatgaaggaaatgaagatgatgaaatattcctgggaaactttttcatatgcaatgaagcctgtgatgagaaggaacctttagaaatagttttattatttgggtaaatatttctagacttatattcccttattgatatactcaatatcagaaacttagatttattattagagatttttaatccatgattcaaaattgtaataattattttagttgtagctctttatataatgaaattaaactacctgatgcatattaatgaataaataaatgcacttagtcaatctgactagaaaaagatattaatcacgttgtatggctttatatggtaaaacattagctggctagctaaatattacatttttaacttggctgggagattatatataatatacaaaaaagaaaccaaaactatctagacagctaaagaagcaaacaatacacatgaacactattttaaaattgaggtaattaagaaaaaaagaatacatatgtgtgtgtgtgatgaggtattactcatccattcattcatttattaaaaaatatttattgggcaacctgcttgggtcccctttcatgccgtggaagctttcttcttttgctcttcacaataaatcttgctgctgctcactaaacaaaaaacaaacaaataaacaaaaaaactgttgaacacctgatacagggtaggcacgattctaggtggtaggattagaatagtgagcaaaaaagtcaaagtaactgcctttgtggagcttgcttcctgattatcaggttacgtaataattatccacacttggatttgcacattcagatttagattactgtaaatacaaagccaccatgtgtgtgaattagagtaatagaaagaaaatcagaaaatctggttttcaatattatctcgatgtgaccttggccttgtcatttaatctctgaaaaaccttttttttttaacctattaaatgtgttggttggtattatcaaaaataaagttctgtaattttgtgtttcctgatagaagaaaaatatgtttgggctcatgtttatagtgtttatatgtggaaagttttcaacaacttaaaaaaaaaaacccacaaaactctaattgcaatcaacagcaaactgagacaggtattgcagtacttaagtaaagtgatgggtagctcttggcaaagttcatgagaaaaatcaccacactgattacaggtattgtaaagggttgtcagaaacagcaagtaaattgcagagaaagagatccacaaatcctttccttaaaatcactactattatcacggtgttaactgggtaatttttccagcacaaggggcaaatgcatttttaaaaaacataatcagttaaatggtacacatagaaaatgcccttcttacaacagccaatctgaggttattctattaaataaaataagcaaaaacacaaaaataaaagcccacattacatataactacaaaagttatctgtttagaagatagactttattttttcagctttgtaaaacagacttaagaacagaatacagaaatctcagaaatcaagtctcatacagacctaagcaaacctcattaatattcaagataatatttgtaaaaataaactttgaattaatcatgtttgcattatctggtattttcattaaagaacaagagagcatggagttgactataaaatgaaatttgtttctagttgcttatgatttaaacaaaccagcgtcagattaaagagcttttactctcagtaccatagaagctttgtcttggggtgtcctgggcacagtttatgatctagagtcagtgtggatcatatttcccataaattacaatccatttgaggaaactgcttctttaacactgtgtcactgcttgtatacctagcgaggacctgttaatgtgattattctttgtactcttttactcgatcccttaacaacttttatttgtgctgtgattcatgttttcaaagtgctttgatttccattacgtggtttaatcctcaaacacttccttgaagtagataaggcagccatcaagttctctgagcctcagtttccttatttattatatggaaataatagtaataaccttagctgcgcgtggtggcgcccgcctgcaatcccagctacttggaggctgaggcacacataccttatcataaggtttttgtgaagattaaatgagataataatgataaggaggatgatagttacatttcttggtcatttgctatgtgctaaaaactattttaattgtgctacactgttaacttatttaattcttcattgtgaccctaaaaaacaggtgctattatttcctcattttatatttgagaaaactgagtcacagaaaggcaaaacaatttgcccaacgttacaaaaaagtgaccgatctagttaaataatgacagaagccacctagaattatattaacacttgaaataatattacttccctccattagtaaacacaatttcacatcaactaatgatttctacaagactccaatatagtcattttaaatccctaatggaaataagggtaacaaaaattattcagcatacattctatctattctaaataagttgctttgatcctgtacttaaagaaaaataaacaagtaactgaatcttaattcatcaatatcctatatatagtcataaatatcatttgttcaatttaaaagaaattagaatatggccagaaagagtcaggcaagaggactaaataaataagaagtattctaagtattttaaaatgccttttggagctcatggatttggaaggggttagaaaaagagagctgacatttgggaacctttataaaaaaaggtcttaaaaaaaatctatgaagcaagaattatcaagtatcttttaaaagatattgtttgtcaaaaacccttatacttaaagagatataattccttattggattatatttaattttttttccaaaagcaaaactgctacttatgaagtcatctgttaaacaatttatattttattctaagcaaaattccagttacaacatacatgctttgtgaagacacagtcaatgtgttaacactaaagtatcaatgcctaggctataattagtattcaataaatgcttcaattatgaaatatggaaacaagctcctgctagtctatcaacagttataaaatgcatcattacacacacacacacctacacatccttccgtatggctaaaaacaaattttaagttgtttttcttctgccaaaaactatcaaaaaatagatcatgatgatccccaaaagatcaatcactctttatattttaaaaatacatcttaaaaaaacctaacacctagatagtgattttcaagtacagggtacacatattgattaacataatgggaaaattaaagcatttataaagtgctctaaggactaatctactaagaagatttatgtttttaattaaacattttaccatggcaatatataagaagaagatcttggctccactgtcagacttaataaagctagcattgcatgaatcagaagaggagacaggggttttgaatagagaaaggtgggtagatgaggggaaagaatattgagttgggctgaaatcctcatcctgttaacaagtccctgaattactgtcagcgttattgttaagccacagggtatctctttacaaattagagaaaggttacactttatcaagacccattatttctatctgtggaaaactgtcacaacatacttattatggaaacagaatctgtatcattatttaactcccttaaacttaataatcaacagatcaacaatatccatgatgcaaatagcatactgttagatgtagtgacattgtgcactgtacaaacaagcatgcatgcctgattgtcatgtttgagacagagacttcttcatcttattatagacacttatatgactcataatgtccttctgctactaaaaaagagcctgaaaatttggcctacattgtttcagaaaactgagtcccagtcttctcagcatttccacttatcctaataagttaacttataataaggtaataatttgctttacctacttataagatagtctacttctgaggatgacaaaatttaaggactggctttctgagtttgaattgcacacaaagtattcaattgcttttccctacagatgcagaaaaccatcaaccatgtctatgtgtgtgtatgtgtatgtaaataaatttatggcttgttttcccttccatcttttcttgaaataatgttttgacattagtgtaccttaatacatcaatatgtttttggtttgattatgtttttcctgttactgaatgtcctttttggatatatgttagttcttagaaaggctggctatcacctagtgtctataacgttaagaaaatgcctgcctgttaaatatagagacataaagcaaaacaacagctgagcacttgcatcattgttctggagggcaacactgattacccactttagttctgactccaataatacaacttctatctattaactaaataagcagtattttatttaaatgaagactggtatgttttagaaaagtcatctcaggattatagagctagtgtatttaccaaattatccttttctctgacccaaagagtcttgagtgcatggtttatgacagtttgttgaacacactgtgctggaagtaattattatccattatttttagaagggtctaatatgctactgtgaaacctttttttcccctgcatcaaaagaataatattattttactactagtcatatattaaatttcaaaacttgataaagcattatgatccctctaaaatataatgatttataacttgttttcccctcaattttaagttgcattcttatattctatttcttttaatttctaataatcatattttcattgaaacgatctttgttttgattataaattctctaagaactggatgatctctataattgaattattatttccgaaattaggttgaatagctagagtttattctgtgtccctcaataaggtatacactttacaaagtttttctcatttgatccacagagcattttagtttgggtaaaataattatgctcattttgcagatgcaaagttaaaatctgcatagtaagttgtgcagtttcttaaaagatgagggaagtgtcacaatctgtagagctaggatgtgaacccaggaagcctaacttcagacctggggtcttagccacagtgcaagactatgctaaacggcttcagcaagggagcttttacgcatggtcttctgagggtagttgatatggcaattccaaatgatatgaaaaataatgaatcagtgctttccagctgtcctcaatgatttgctccacctgtcttcaggcctttcttttatccatcagcactcttcaccctctcagcacaaagaacagcctccctcggggactgggtagagttgctatctgacacccaaaattcacaccttgcttctttgcattctccctgacatctctattcatcagctcatctgtctgcttcagagtcacaattctcttcaggtttggtttcgaaagcgaggctcaaaatttctgttgttctctgaggctgtggatccctcacactcacaggatgcctcttttcgcatgacagagatgcctaagttcattatccacaggctgcttctgagtgagagagatttcatcctttctaaagaccttcttgactaaagtagttctctttacctttgtcatcttgcagccactctctcgacagatgaggcacccagcatgttctatttccatagcatttacatattattaatagaagcaggccagtatctaaaggatgacattgaagaagagttttttttcacattttaccacagggctctacaagaagatgatcttgccagtgttctcttgaaacaagtttcctttttctcaactcagagaaatgctttttatgtaacatttgtgaaagattcttatggtctactatttttttaaatttcctattgtcggcctgactggcactgtgaaatgacatcaatattgtcagattcaaccaagagtcattatagccacaataaaataccatgtctccagaaactatttatttaagtataaaaaggaatcaagcataactttaatgagatttctcagactgtgtgtctgcctgaaagaaatgtgttccctctgtccagtcaatgagaggatcagagctctttccagctttctctcattacctgcttgttgactagtgcagccttcaaaaagataaccaaagactccctacatctctcagatgctatgtaatttattgtgatgtaatgtattggtctataattatgtcttcattttttcgtccactttgactacaaaatcttcctttatctttcttgttttcttttttttttttttttttgagacggagtcttgctctgtcgcacaggctggagtgcagtggcgcgatctgggctaactgcaagctccgcctcccgggttcacgccattctcctgcctcagcctcccaagtagctgggactacaggcgcccgccaccacacccagctaatttttttgtatttttagtagagacagggtttcaccgcgttagccaggatggtctggatctcctgaccttgtcatccgcctgcctccgcctcccaaagtgctgggattacaggcgtgagccaccgcgcccggccttcccttatctttcttactgtgattgcatttactctgagacttttagctttatccttgactgtaactcaggcaaattactaattacaatcttctttaaacttctgatattgatttctggctttatttttctaatccatgctgtactctgatttaatagaaatttttaagaaacaccaatgaaattaaagtttggctattactttcacataatacatattattcttcttctataaaaacaaacataacaactcataaaaaatgacaagaaatggaaataaaacatagggatcaaactggaatgacttctaaaaatagctagagttactgatttactataaaaactaaacagaaagtttgcaagtcaaaaataagtttattctgattattcttttgtaagttcgctgttcgaaattttaaatgcacttatattcactaccacataccaggaaacatcttggtaaacagagatttttaaatcagagtcagaaaaaaatgttatccggcagatacagaaataaagtgagggatggagaggttgagttaccttattgagaccttggcaagaccaaaagcaccaatgatctagaatggtggctggtggttctcaaggtatagttaagggataatgtgcattagcatcaccataaatgtttattaaaactgcacaccctagaactcatctctgatctattgtgtcagactaagagtgaaacctggaaacctgcatttcaaagatacttcccaggtgactgtgcaacaaaattagagaatttttcatagctatcaatttatagataagcaatacagaattagaaagtgaaaataaagacgcaacccagtttgtacatttaaaattcttctcatccagttgcatgatttgcattaggcatgccttgttttcgtttggctgttgggataacgggcccagttatcttatatcttgtctatattctgttactgtcagagaaaaggcaaatttaagtcttatttgaaatgtgtgccttcatctgggtcataaaagttaggtgtgacctttaagtacttcatagagtcttaaaaatatgtcagtttcacatatatatgtacgtgaccaatgaacttaatatatatcacctttcaggctgaacataaaagcacatgtactttcttagtgtaaaatgaggtagaaaggtaaatattttaaaacataatttgttccccatatttttacatgcatgtgcctatacatatgaaaaaaattgtgtgttttcttcctagaataaagaaaaaaactaagtaaaaaggaaagaagtcatcaactgaatgaagggagagaaaataaattcctgggaatgtactgttcccaactcaatgttctcagccaacaattgagaatcataattactattaggataaaaatacttcaggccaggcctgaagttagtgatcagctgctaagaggaatagtagttatcaacatcatgagaataacagtagtaaccaagcaaagcaatgcggtctgtacttttcactgaatgaaacatcaggtatttagatcatgttttctttctataattttgcacttgttttcaattacagataattatgtacttacaatattgttttatatgttttatggaaggaaagaactcctcctagctttaaagtaaaatagagcaaaactgacttgaccccgattttcctttaaatccgtatctcaaagtattttaaatctgaagtaaagactacttgtgtcaatgcaacatatatttttgtagacctttgttccttgttgtccaccacttctatgtactatatccctctcacatctgcttttatatctatagcatccggcttgcttaagatccatgatatctcaaattaaactaagaaatagaggcagtgaagctgaatgtacaaaacagaaagtttgatcttagtagactttcttccagtacactgtgttctgttttgtgattcacacccaatgatttgtgtattgtaacaactagctcagattccaatgtggccaatactttcaaaccagacactattcctaaccaaaaatatggcaagtatcccaagaacagaattattaatgtaactgtcttgtcattcactgactgaaatatctaatgaggaaaaggcttctattaaatatactataaataagcatttaacatttggagctttaaatgacacaacagggaaacatttgtgtagactgaaatctatttttattgttgattgaatcagcagtttgtaaggctgccaggcaatggatcagtacacttatagaaaaattaaatttaattgtatttattcactgatgaatagaaaccaacccaagacaagtaaaaattgggaaatattttttttattgctcacatcatagcctgagccaaaactgtgttaaattatttaatttgtgtttctcttatattatagcaaatgggagaaaacaaaaaacaaccttcctaaggagtgctgcgtttgggatggcaaataagcattaagtgattaatgcccaatagtgaccaataaataatttagttatctctgcagactttctgttttcttgtaatattttgtttctttagatacataatacacttgcccttaataatgaaaaagtaaatacaaccataatttattatttttattgggctaccagaagtaactgttgtataaggacaccaatgtgggtggataattggcatgatcttccaaatttgcagattttagagaagattaatatttgataatacagtcttaataatggtcgaccattgaaaatgaggttaaaagcaatcaattttcaaaaagtttactcaatggtttataaagatatttctaagaaattgaacttaactagcaaagattatagttttaatctgtacgtaaaatgtattttttaaatcttctaactacctaaaaactctatttttttcacattcgtatattagcatgtatatgtgtgggaggtatagttctgagatgtttatgtttcatagttcatttgccttaactattagaagttattcttaaagtacttgaagccagaaggtctaaaccaggggtgattttgccccccaagggacatttgacaacatgtaaagacaattttggttgtcacaactaagggagggctattggcatccagtgagtagacgccaaggatactactaaccatcctataagacaaaggacaggcccctatgtcaaagaattctgaggccccacatgtctaccatgccaatcttcagaaaccccgtcctaaccttttaaatttgaccttattttcaagcaaatttcttagttcagaggaagcactcttttaaggtagcaacagaatggtgcatgctagtagtgcctctcttgcccagtgctgctggattggtactgaatttaaactagttaatgtgaatccaggaaaaacaagggcaggtcatcatttcaagataaaatgactaacatgaaactttaatagccctcagtgttgcaccgctttctttgtctttctatgacaataaacatcatatttatgattactttgtttttgttaggtgtgaagatagaattctaatgaaccatcaaatatcataaaaaggcagtgagaacaagcacctggctcaaaggtccactgcctgctcatataaggtcctaaattcactctggtagtctatataaaacaaatgagctgtagaaaaatgctttttctggcagtgtacctatgtaccttaaaacatttctcactaggaaaaaaaaaaaataaagcaaacatatacacataacccccccaaaacaacaaaaaaactctgtgttggctaaaatggcagacacattttaaagtatgcagagcatacatttcagtactaaattattgcaaataaataaatccagagaatgtaaaatgaaatatacaggacttcaacatatccaaatgtcaacgaacaacaagtagttgaaagaccagccttttaatatgcaccaagaccaattcttgggctacaatatacctgttcaaataaaacaaaatcaacttaatgtgaagcatgtgttgaaggtactctatccctttaactatctccacttggctgttagagtgaaatggtgttagactattctcattaacttttaaaagcttaaagaaaagccagaattttacacttctcagagctaataggcctttcgtttattgccaatcttaagtaaaaattcacaagtagaaagatgccaaaacatatttgtctctctggatacctttataatttttttttaatttcaccaaatcaatatttacatattttatattttaatttatacttttcatatgctaaaattatttttataatgcacttaatggcttacaaagattaacacaaatagcaaataaaaaataaatctaaaaatgtaatgaaacgtaccaagaacacaagaaaaagagaaaataagaacaatgagatggagacagaaagagaggcacacaatttacagtcctagagactcacttgtagaagccactgggaattttgaaaatgtcagattgtatctcaataaataactataaaatatgagctcagaatataccatatcccatatcctaagacactgcagtccctcattttggtaaaactattgtttgtcttttctttgccatgtcctgtctttaaaaataaatatcctattgtaatttaataactctctttatctcagctatgctacgtccctcaattagtcccatacccaaatggctcacaaacacacaacactcttttcttaggtccagatccacatattcacctacctatttgacatcttttgttatataacctcaagatatctccactgttattgatagctccctctgcttcattctataacctatacatctgccgtactgccaactttccatttttactaccttcatccaggtccaagacattatgatagcaactactgcaatagctttttaatgggctctcagacattcactccaaaatcccctaatctgtgaaagcaaatctggtcatattagctcttcataaaatattaaacagtttccctttgcaattttaaaataaaaacaaactctttaatatgaccaaaaagtattgacttggtcttgaaacaaaacaccatttcaatcacatttcaacccccctgcttcccgtatttcagctactatggaacttcatttccattctcccagctccattctaccataggacctttgaacatgctgtgtttcctctacataacatccttttttcctttacattaaacatcttgtcatctggttcaccccattcctctttctgaattcatcacaaatgtcatttctttagaaaagttttctcagatcccttcactaggcccaacctgcctaagggagtctcatagagctctgtggtcctccctcttcttcctgacatagatgcaattttgtgtgtgtttgtggaacgccctagtgagtgtctttacgcttcacaaggatagtgatatggcttggctgtgtccccacccaaatcttatcttgaattgcagctcccataattcccatctgttatagggcggacctggtgagagataattgaatcacgagggcggtttccaccatggaaactggttcttgtggtagtgaataagtctcacaagatctgatggttttataaggggagaaaccccttttgcttggttctcattctctcttgtctgctgccatgtaagacatgcctttcgccttctgccatgattgtgaggcctctccagacatgtggaactgttagtttgttaaactttttctttataaattacccagtcctgggtatgcctttatcaggagcgtgaaaacgaacaaatacagatatcaaagagggcagaaaccatgactttatttttgctcattactagaccctcaagtctaatgcccgttcttgacacttaatgcctgtccaacaaatacttgccaaatgaataaatggatattatagtggtatcttgaattaagaatgataaaagtcaaccaggcatggtggtgcatgcctgtaatcccagcactttgggaggctgaggtgggtgggtcacctgaggtaaggagtttgagaccaacctggccaacatgatgaaaccccatccctactaaaaatacaaaaaattagctgggcatggcagtgcgtgcctgtaatcccagctacttgggaggctgaggcagcctggacaacaagagcaaaactccatttcaaaaaaaaagataaataaaagttaactatttgagatgttggtgctaatttctgaaccagtgatatacactgtgtagaaaggcacataatggcataaaaggtcagtgtttgaaaattattaaaaggataacataatgccccaagaccaataataaattcttacatatagaactcttatggtactgtttatacacattgttttattactccagatactctatgggacagaggatattattctcctttttatcaagagaaaactgagcttaaaaaagttaagtaactttctcaaagtgttttaaaatgtaaatgatagagctgggatgtgaacccaggttgtagtcatttcaaagtccgtgacctctatgctgcatagcattagtagtgtctaaatttaggtgactatttgggggaggaggtcatgaattttttttaatgttaataatcttcattcatttaataattttggatgatcgccctctataacagagacttctacatttcatgtaaatataccagggtaaaactttgcaatttttaaaatcacagcattaactatacaatggggtcactcaatgaaaatcgtttatgaatatgaccgaagatttcattataaaaacacccaccaccagtagcccaaaaacattacaacaaggctcttgtgtggaaaaaaaagtatttctctttaagaaagacttttcttctttttttttaatcactggcacaaaaattttctcagaaaacactaaggaatatcaaccaatcaaagacacaaaggtttatcaaggaaggtttatggaaagcaaatgttctccaaatatgcaaatccaaaaaggaaggacaaggctgggtgaaccctgtctgcagatagcacagagtaactgagtaatcacagagtaattgtgactgtttcaagaactgtgtttcagatcatgttaacttgaggaacaataaataaatcttgctaattcagtgaaactgctggttttatgaagaacctattgtgggccaatattttataattcaatattagtgatacactgggcaaattttctcattaatgacactgcatcatcaaactgcataaatgctccactgaccctaactatttgctactgacctccacagtttgctggaagtagcagttgtgtatgtattccaaatttaaaaagcaaatttctatttcaaaggacagatctgtgactgcctttaaacaatacagactcatttaatatctaatttattcagaactgaaataatgtcacacaaaaagctctacttttgtttttcagtaacagtatggaagctgtgatttctgagcaataatagaagaatacttcagcctctcagccattacagtaagcagagaatgcaagagaatgcatgagttcttttgtggaaattggcagataatggcagcttttctgaaatctcccacttttttaaattggcaatccgataaaacctttaaatttggggagtgggaggaggaaatgtttcaataaccacatattaaaaataacttgctaaagaaaggccttgaggctctcggatatactaagaacaaacaatcaaatgtatcctgtacctgggaagacaaaagcctcacaatcacgatgttaaaaggcaagaaccttgggctccagaggttaaagggtagcatcctgatgccataattaggcaactggatgcatagcaagaagagttctggaggggcaattagaattgtcaccagatccatcctggatacatcactaagtgtctctaagccttagttttctgtctttggaacacttggtttggctcagtgctctattaggcctagcctggaattcaagattctaaactctcagcaggaattttacctacaaagaaatataaaactagactccacatttttgagtcctaattcagagacaatgttgataatttttatatcattgtatgtcacaaatctgtagatgtcaaaaattcttacaaatccttatgattatggattttctgacagtacagtagaaatcgaccaagggcactgggttcattgaggatattttattaatgagacttactttttgattaaaaagtatgtattaatattgatttcaacatacctccattatgcaatgtgactgaaaacagaaaatactagtcacaaagtgaaatgtaattctatttcttttaaatacttctgcacctatccatttaaaaatatttggatgaaccacaaaaaatgtctattatgcatcaattttttacctaagcaaacctgcaattttatacgttttaaactgaatgaacttgtttgtatgtgtgtataacatgaattaaaatgctaggtaattccaataatcaacaggatatcctgcattatcagaccttactaaataaaacaagcttttatcggctacttactctattgcattggtcttaactctattccataatggcacagtttaaatcaatgttttatttttatattatcattttcctaaatgcacatagcaggaggggaattttaacattgtcttcattattttataggaagtatcacagattatgtaagtatcttgtccaatggggataatatgaagataggctaaagtcttttggggcttaaaaacttagtacatcaaaaggaaatatgtggagttattcaggcatatgtcttttattgtcattgaaacataatagaatttggttacctttatggttattcaaatgctgaaaaaattatctgtgatttaaaaaaatcaactggcagcataagcactgtcatcagttgatgctgatttctctaagctccttagcctttatatcacttctactcgtacaagggatgctttgtatatttctcaggcaagtttctcattttattttgttttgtttttaaattctaagtagctttaaaaattgtgctattgttccatctattcttctttccaattttgttaggcatttagtgacagtgggctttggtggaaacttatccattgctcagaccagggacatgagtcttgattagccaagacattcctggtagaacccttctaatgcctgtgactggctcagaaaagggccaatgacactggaggaaaactgctggggaacttatgggaaaggttctcatttgaaacatacacccacccagcatcctagtttatctaaggatgcagttatatgaggatgcaatgaatgaaactactgcacccattttgtgatcacagtgcgacataactaagggcaaaagccaatatgctgaagatggcagagtgaagatgtccaggttctaaagaacctggagttgtcaaactacctgagctttggattttttgttgtgtgacctaataaactggtgtattttctccttaaagagaaagatcacatttctgtatgtgtgtttgactgtgtgaatatgtgtgcctgtgtacgtatataaaatggtcaataaaatgttaatgctgattttttaaatgagtttttttccagtatttctttactggcagaattaaagttggttataatctcccccactttttatgcatgttcctatatttagtgtaggagagttaaaaggacaaggaggaaggatgaggcaaaaagatggaataaaattttattttggaatcagaaattgattactaagaacagtgacttgaagcaattcacttttggagtatctgtcataatcaataactacccacagcttggttaatgaacgttatttttagttgaattactaacaaaggaaacaattagatatgatcaccaacattttcatgcattaatgccagtgcaaattaactcctaccactaaaattactccttctgtctgtcaaaatctgtgacggctatgacttactgcacgcagagcataattgtgtctccctgcctgcataaagctgacacataaaatcaatattaattaaaaaaagatcaaaattgtcctcattatcttatttggctgtctctccaaaatagggttaccatttatgacagaataaaacagagtctggacttaaatgattcctcctgccaaataataaatgatccttttattggttggatctattaataaatatctatttctctatggatgaagttatgcatagtgtaactttgaaaaaggacccaatgtctaactataaattcatctagactatctatgacactttgccatggatatatttttgttctacacatctgtattctctattctctcctctgcccaaatgctcctaatacaagaaaagaataatcatttatatcagaagttgaggatcactgtgccctgcagaatgtatataatttatttgacattttatcttttctattataatgaatacaattttaagttttattattattacacatttattttaatgaaaaatttgtgggttcctaaaatactgagagaaatatgtgagctcaggagatttctcatgttcatcaggaggttttgcaaatttgtgcctcagtttatgaggtttcatgatacttcttttcctttccactccattttcttcatgctggctttccacacagcaccttaatgaataaaatgacaattccagagaatgttaccatcactaggatgacttagtatggaaccctaaccctaatcatctcaaatcgattgacccccagaaacaaaaatcacagggttagtttcttctgttctttcctgctcccagtgatgccttacagacatctctgagaactgggagtctacatgatgtgagatattttcttattaccatcaaaactcattcaaacaatattcgctttaataagttggtgtttacttgccaacaaatatcaataactcacaaccacaaaaaataattaaaaaggaaaagaaaataaaagaaatataggtggtttatgaatattcaatcaatcactttaaaccacaggtaattttatcacttattttgtcccattttaacaatttatgctcaagatatagtaaaatgaagtaaagcttaaacctttgactaaatgtttcaaagagaaagaaatttaactttgagaattgcaatatttacatatatataaatgcaatatttacatatatatatatatactcttttttcttttctgcccttaaattgccacttatacatagagtacatcacttctgctatccaaatgatttggtttgctttacagaaacccaagtttggcactttgggaggccgaggcaggtggatcacaaagtcaggggctcaagaccatcaccctgtctctactaaaaataacaaaaattagcggggcatggtggcgggtgcctgtaattccagctacttgggaggctgaggcaggagaatcgtttgagcccgggaggcggaggttgcagtgagccaagatcacgccactacacttcagcctgggtgacagacggagactccgtctcaaaaaaaaaaaaaaaagaaaaaagaaacccaagtctatatgattataggcaaattatttaatttccatatctcaacgttctaattcatgaaataagcatcataatactactcacctaataggtcccttgagaggattgagtcctcaataaatggtaactgctactattaataaataataacatcggcagattctaacactcagtcatatagacaataacttcaggaaatattctccacaacattacttacttccacattttcacattaaaggtgaggaaaattgatttctgaagttcagtagatagacccaaaatcatcctccaattagctggtggcatagactgaacaagtgaagagacaatgttcaaggtcactagaacttgctgtagcacatgtgaaaattgtagcagaaataaaagtataagaaaagacagtggtttccaaaataacactgacattttcactatagagagatgacaacaaaattagaacatttaaatatttttaaaggatttgttttctcttctatgacaaaaatttgattttacttttgcattagtgaagcgatatgctttttgaacttgaggttaggtgggtccctacctcgtgtctttgttgctatcagtttgtacaactaaaatctaaatgcctcggtttccttctaggaattatgagctatgcacttaaaattcactgaaattttaaagtgggtatgctctactaacaaaattaataagaagatgttaattgagggtggcaaactaaatacaggaaactgctcagcatttttttgtcagaaaatatttcaaatgagacaattttgtgcctcaagagtttatgttagctgggaaatggagaagggaagttgggagaatatctgaagaaagggaacatttaatgaacattaaataataagacttaatgttaagcacttcccacatcaattttgttttccagaaatccaatgagaaaggtaatttgcagatgaaaagaaaatggaatgtcagttaatttgacaaatgtcaaagacatgtttaaaactttgaaacttatctaacagatttaaccatcacgtgatcttttaaaccctcactacagtcccatcttctccttttccttacttataaaacaaccctagatttccttttcagtgttaaatagtattctaccttgaaaagaagtaagacatgactactttatactgaatttattcaataaagaaagaatttgatcacacatttctgaataattactgctttgtgacaaaatgaaaattaatggaaacagaaagtttcctccttcatagaatcaccatttactcactagctttgaaactaattctagcccaagattgccctcaaaccaggtccaaacacaaactgtaatccttataaacaccataactatgcagggtggaattatcacccacactgagccttttctttcaagtgttatttctgatttcacatgtgttgagaacatttatatacaagacctgagctacacaattttaaatgttattacttgtaaaatataagctgtgtctttatagtcacatatctttataatgttacaagaaggaataataatataaacaccatcacagttaatttataataatttggtaaaaacaataatattttaataatgaagctaaggtaatatttgtaagcaaaggaaatccccaatgtggaacaaaaaagaatgaacagcaaagaggccatcaagacctcacaagtgctcatctccccagatataagtacttggtcaatatatgtaagaaaatattttctctctaatgataagaataaaaacattaattataacaagatataattaataatcagttactacttatcgagaatctattaaatctgaattattccattcatatttttaaagggcttgtatatatacatagtttttcatatgcgggtatatggacccatatacatataaatggtccttcatttattctattgaccttcggaaacttgttttccccattttatagatgatcaaattgaggtccaggctacttaagtgacttcactgaagcaaaatccaagtagagagatattacctgtttaattagttgacatgcactgagctttagattgtgaatatgtatattcataataataagattatggttacatgaaactgtaaaaaatgctgttcttttctagggaaataaacacatgtttagcacagaatgttaaaagtagcatggagtagtatgagataaaattaaacatttgctttcaaggttatggcaacaaatgaccacaaagagaaaaaatgataactgaatcataattttctgacaatctcttggtgtttctgtattcctcctttgtgcttcacatgctgccctctcagtgaaaagcaactataagcacatagtctccaactgagcatgcggctggaaggcatgcaccatcatggttaattaggcaggcttcagaattcagcaagtagggtgaatcttagctatatcacttcctagctaggcaaccttgggcaagcatttaatctctccaaatctctgttactcatctatacaataaagttgataatagtatctacatgaaatgactatagctagaattaaataaggccagggctatcacaatacttggtccatagtaagtgctcagtaaatcatgcttatttttatatttatatctgcccccccccaggactgaaaaaaaaccactttaactttttcctctagaggtattactgctaataagtgcctcccctcccctcccttcccttcctctcccttcccctcccctccccttccctccctttttctctttccattgagaaaaccaaatctaacatgaacatggcattttcctttctgtcttggtatagcctatcatttctggattcaccatatggttaatagatggtggtgagacatagtgtggtatattagttcattcccatgctgctgataaagacataagcaagactgggtaatttataaaggaaagaggtttaattgattcacagatcagcatgcctggggaggcctcagaaaacttacaatcatggtcgaaggggaagcaaacatgtccttcctcacatggcagcaggagacagaagaacgagaaccgattaaagggggaagccccttgtaaaatcatcagatctcatgagaacttactcaccatcatgagaatagcatgggggaactacccccatgattcaattacatcccactgggtccctttcatcacacgtggggattatgggaactacaattcaagatgaaatttgggtggggacatagctaaaccatatcaggtggaaattttaaaacagtaatcaagaagacagaacccttcctctcactgccaatgggacaactagcccagcctcttctgtgttcagatcatagcagcatctagcagtgacttgaagctagggaagctccatttcaatttctgagctaaaactttttctcctggcacccaaatttatatttctgaatcagttttgccgtagaaaaattgttatgcatggtggggaagttctaaagttgttgtacattattacctacctcaagaacattaaggattaaggaggcttccaagagctcactggtgtgaggggctggtgagcaagcgtactactgtatcaatgaaaagatgagggatgggcacaggggctcatgcctgtaatcctaaaactttgggagactcaggcaggaggactgcttgaggtcaggagtttgagaccagcctgggcaacataatgaaacctcatatctacaaaaaattttaaaaattggccaggcatagtggtgtctgcctgtggtcccagctacatggaagctgaggcagaaggatggcttaagcccaggagcttgaggctgcagtgagccatgattatgatactacactgcagcctgggcaacagagcaagaccctgtctcaaaacaacaacaacaacaacaacaacaacaacaacaacaaaaatgtggtctgattttcaagtacaattcacaaaggcacatttgaaacacaatccactcagagactgggggctgcttttccctttcttttcattggccactggccactagagggctgctgtgagtcatcccccttgtcagaggctcttaaggctcatagttctgaaattaggatgcatttcaagggcgggaccaaattctcctccacttctacagtatctgcagagtgtctagaaatgagaaggaccgtttcaagagctcataaatatcctgttgtggaagacagatgaatgctctgggttggaagcaaatttttttttaacacatacctagggaacttatgaacactctagttagcttcttcaatgtgtctgaagactgctcacactcctgttgacaagtaaagagggtgaactctaagaagtatatttaaatgcaaaaatgaacccagttcatgtgcttttcttgtactctctgtgttttagggtagattatcatgagtggtaaagaagatagagaccggcattagagggtggggcttagatacacactcatatacaacgggtcatttaggttgcacaaaaatcagaaagatggccacagatcagaagtggttttccactcaaaccactgacctctgggttgtctttctgaagaacttctttcctgttggttagagtttacttggtatgttcttgacccgtgagacaggaatgaggagatcagacaaatgggaggtcagaaaggaggaagagattattcccatgtggaatgaggtttcctaatttatagattcctctgtggatgtttggtggaaacaaacctctccccatttgcttaattttctcttgctcttcacacaacacagtcaaccatatgttagactcttgaaggttccatctctttccctggttttcttttaattctatttcctctcaccccaagccaatccagagggtggaattccaacttcgattcagacatcaaagccagtgtggccacacttgatctatctcatcttctttaatagacttaattcttctcaaggcaggtcaagattctattatctttggtaattttatctaattcattaatcaagaacaggattttctacatgagtaatatgagtaataataatatccatctatgtgctaatcttctaattattttacacatattacttcgtttcttctatgaacagcctatcaggaaaattgctggcaacattttagagatgaagatactgaagcacactgtggttgagcaacttgcccaaggctcgcaaccaggagaaggtgtatatgggatgtgatcaccaaaagtctgttttccatatcatcaacactgtcctagctgtggctaaacacctctacctctgctatgaccagcagtctctatttttgagctgcacctagcatgcaccagacatgataatgataatctcacaagcatcacttcccttagtattcaaaacaacatcatcagctgggtactgtccccacgtatagacgaagaaacagaggcttggcagagtttagtgcgatatcagaggtcacacctctagtaataacccaaccaagactgctgaatgtttctctgactgcaaaggctgtacttttacccagcaaatcatgttgctcctatagaaagactgcacccaaccgtccctggaaataccataggcctgttttagcacactgcgcagcactgataaggttaaatagaaactgtgattatgcatcactgcattgctaatatctctatgaataaaatgtcgatttgattttcatttaacctcaaaagaatctgattaccaaataaccattgaagaattattggcaattatgttctgtaattatggtgcctgttaatgtcattagcgtacagcctttcatatttagtactattaattaatccccataagcatagaaatttataatcaatataacaaaggctccatggtaaattataaatactcccgaaatccctccaacagtttacagggctccgtgggcttccttggttgggacacatttagtttgggggctgcaagaatctgtggtaattgatagcttttcacccggaatcggctatctcactaatgtgcctaattaggcaaatgcttaaaactggagtcccaactgccactgacaactataaattcctgtagggcaatcaaaataattaactgcttgagtcaagagacccacaaatcagatatacaacttttcaattctctgagcaatatactgcttcagataacaactactgtcagtgagtgtctggtttcggttttggaggagttgaatacagtaagtatgtctaatgttaaaagtccaaaaaagattcatgatagctctatctcacagatatgcaagataaacatgcatgctcacagtgatgctaggaatggatgctttgtaaagcactggtctaagaatatcatgtttttcaaaatctcccaatccatcctcagattttcttttacacattttctcaaactgaaacgtataagtctgttttatagaaaacctattttgtttttgtaattttaaacatctacattaatatacatcagattttttaaatggttacattcacatattttatctgaaacaactactgctataattgtctaaagatgcagcaagctgcctcagaagtggtacattctaataagatgtggcatgataatctattctgcattgttcagaattggactagttggtttctgaggccctgctctatgttagaatctaaaagtccgtgaatcccattcttttttcccacagagaaaagggattagaacttgctccctgttggcatcccacgccctttcctgattccattcttgttctggacaatttcccaggaattagtgcataaccctctacagctgctgggcctcagaaacaatttgggaggagaaaatagaggctcagaataaagaaaatatctattaaagcattattgcatcaaatataatggagaacatgttcatcttttaaaaattcaaaaggaagaatatgacacatttaggaggcatccaaaaatcacctttttcagataaataactgttagtggagaaataaaattaacttgcaatttggaagaattagtaggcagaattataatatttaagatctgaaaataacctcaaaggtcatttgaatccaatattccattttacaaatgagtaaggtgaaattcagaaagggtaaataacttatccaaggtcccaagtacattgatggctgaaatggaactggaaatggagatatcttaactaccccatcttccaccacccctaaactaaatggttaattaaatttaaaagcttattacagggtatgcttaaaggcacaacttcagattcgtggttttaaaataaaagattgtatcctaacatcgctgacaaccacagttagcatggattctcagtcttgtcaagatgcagaagtaagatatgcatagacattgggatgggagatcttatcaggtcctgtagttctattctacgagctttcagtaagttttatacaaactaaaacaataataataataatggatgataacgacaggagcctatactattttgaggctgaaacaactacatctcacataatttgtcacatagcattcagagccctcatctgacctgtagtcatttttttcatttctgttttggtggcttctatagctttttatttatttgtgtttgtatttttttgaattagttgtcagtagtcaaaaattaaaaaatgtcacagaaaacctgactacaattttcttacatgtagctcactagttgttaaaaagcagagaaataaaaaaggaagagaagagaaaagaagagaagaggaaagaaagaaaaccaaagaaagaacctaatgcaaatgatgagataatggatgcagcaaaccaacatgacacatgtatacatatgtaacaaacctgcatgttgtgcgcatgtaccctagagctgaaagtataataataataaaaaaagaaaaccaaagaattccttctgtgcttggctcagcagcgttggagttcctgactccactttaatgtttccttagtctagcaccaccaccaaagttcttatacaaatcattttaaccaccaccgaagtactgacacaagcattactagccgaagtggttgtagatttccttgaaattaaaaatatgtttcacctttgtagtttcaatgagaataagaaatgaatgtgcagaacgtcattcttaataactatgcttattataagaaaacataaagaatgcataatggagaatgcatatttcttcatgcatgatggttatgggaccagcccttctctgttttatttcctcttccttaataggtagctatgcaataagaacaaattttgaaaaaataagacaaaagaagatattctgatttaaaaggaggtggaggaagaggaggtagtgtcagtggcacaggtagtacctaaagtctacctgaagattctctccaggacatgggttacatgcataaattgggcctctgaaagccttaaactttatctagagatggcatataggctttggatttaacactttctgtgctctatttcatcacatttatagaactgttttcatagctttgaataagtatgagcttattacatgaatatttagtttattacatactactatatacagctgtgattgtgaacagatacacttctgctttttgttgaagataggactgagttagcaatgtctactgtattaaacagaaaaataattctctctggccacttccatattctcccagatcaggacctatacaaacactggggaaaacaaacttccaagtgatggcagcacaatcaagctgttttgtggaaggtataactgctttgcatggttataagcctgccagaaaacatgcaggaattcccaattcccagagcagaaacattgccagcatgtaactctggattccaccccatatgccatatttccagcccatcttcggtcagcacatagtctgtgctcctggggcgtgcaagactgtgaaaaggcctgcataactagctttcatgatgattcctgcattaaagagtaaaagcatctctgttcagctttcaaacagcctacttacccatggccaggaagaaggggaaattaatcatttaattaaattagtcattttccagactaaagataaacttggaatatgactcacttaagcaaaactttccacaggtgtcacttctccaggaagattaagagaagggcccaggtctcctattccagaaaactatttgagggttgaaacctcctccactgtgtatcacctagcacagtgcctagtgaacagtaagaatcaggaaagagttattggattgagtagctattgaattgaaatggaacccagtctgcccactctaaaacagtcactttgaacacagaatgtattaaggtgttatttcacgtgcaggctgttacaaatgttgactcaggctcaaacaaaccttttagcatttttacttttaatccaattgaatgattttacaaaatagggcaaggatataaattcaaataaattaacagtgggtaaaagagcatctagtcctcaaaaaaaaattctttggcctgcctatcatttatatttgtacaattattcctcttctctaaggttcacaacacttaggcttctgaagatggaaatacactgcacagggtattaacttctgccaatggaaataaaactgtaaatgatttggttttgtgattatttaacatataaacatgtgctcattgagaaaaatgatgtctggacaactgacattgtatttctgccaagtaccaagctaatgttcataaaattttactggagggaacccaatgctaactataggatttcaaactgctgatctggagagatgaatcgtgaagcaatctacgttgtatggctaatcagaattcccatccttacccatgctctgaaaagaacctaaaatttctatttggaggcaacttcagaaagctttcattaatttaaattttaaagcagatttcttcccattatgtgtattcaactgaaagcctatttaacacaacaccatgataaaagtgaaaaaaaaaaaaatgtcaggtttttccaaggcatccattttactttattccagaatccagaggcattgaaaatccagggctttctgcatttcttaggatgttttgaaaactaaaaagaactggtgataatttggtgatttcccgttctctgcaatttattttaaacatgtgaaatgaatgactctatgttccttaaagctgcccccaaattaagcaatgtaatagttgataattagatgcatttaattctaatttaatagccatctttatttggcatgctctttatataaatactactcaactgaatcctattaacacttacatggtttattacatttcatctgaggaaaaatgtacatattctaaaagctgcattatttaatcttggtgttaatttactggtatgcttaatgagtttacaggtttagtattatttaaactttgtgaaatatatgtaacttttctttattttacctttaatatttggagaaaaaaaggttctattagggttttcaatatggttataattgtagaatgaaaataagataaaattaaaattaaaaagcagaagtggtacagttctcataattttctacatgcactggagaggaacaggttttcaggaaatctcaaatgggaagtagatgtgttgagcatgttgaactaggaaggctcctagcaaaaacaaatgagatgctgtactgcctctccattacggccaacacagaaggagaaaagaaaatggcatcgtcatggcagtctacaaataactaatcactcccatgcacggttgattttcagtatggagtctggcaggaaaacctcagggactctgtcacccacttgcaggccagcttcacatgacacagtattattattagcagcaatattttgaccatttctagttatcttttctcttcttatctctcccctgaagttgatacaagaaaagattatctgaaaataaagaaaataaataccagaaaaggtttaagtaggaaaaactgcatgtttttaggaaatattctgagtgattagataggggaataaaaagtatgaaacgattatatcatgttctatgtagcctgacaaggtaatccctaagtgagagaattttttactgctgcaaatttgtgtgtgtaaagtgtgactgacaagccacaaacataaattggtaaaaccaaaaggaagtcatttagcagctcattattttacaattttctacatttcaataaattcatcatgacgatttttttttgggggggggcggaattcccaatggcattaatgtactagtttaatagaacaataaaataatattgcaggaaaacatatggctctgccaaaaatattaaactaatataccataaaaggaaaatgaataggtgattcattcactatccatttacaattatttaaattataaaaatgaaagcagcctcttcattttaaaagacaaaagaaaagtcatttagtagtttagtaatcaaacctatgtgagagatcagttatctggttagatattgatctcacttataaatgattttatattacactatgctcctagttcatgatacatatacacacatcctcttattatttattgaacataaatttatatcaaactggctttaagactcttgtaaatttgtgggagctccagttttactaaggcaaagtgagatgcagaatcaactccattttttccaaacaattgattccttatcttctaaaatgccacaattttcattatgccatacaaaatattacggaatgtaaattatcagtaaaatttccttagttatctatttcactgtgaaatatgaacacagcctgtattaataaccatgaattcaaagagaaaatgctttaaatatatatcaggctagcttaatctaagcatattgtttgctgtggttctttttcagaactgaatatcaagctacagtccactctgccgaaagcttccagctttccaaaaactgaaaaccttcgccagtaaatcacaactgttttaccatatgcctctctgttctgccaagcattaccagcttgttctacttttaagcaaatttcattatattatagctcagagcaatgctcattaaaaagtattactgaaaaatgtcaagttgtttttatatagaaactagaatttattttctactgaaaagtcagatatttattgaacacaagacatttttaaaacatagctttcatttcacaagttggttcaacttaatgattatctgaagtactttgggtcttgcaccagttaatgttcactagtatctcccattgatgtagattaaccattgcctttctagaatcaacttagactcagattagtggaaaattctcggtttcttcacctatattcatattctcattgatctgcctattctcctggctccccgccagagccttcttgagaactgctccactggacatactttaggggactgtaaacttcattatagcctattcattatagtataaatacagttcaaagaacactagcttagaaatctcaaccccaccgcttctaattgtgtgattctcaattaagtcagtaacctctcagagtcttcatttccttatttgtaaaatggaatgaaaacagcctgctctgctttttgaacctaattattgtgagcaaaaaagtcagcaatgcatgttccaacattatgtatcccatttaccatatgccaaacacaaaaccagaaagcttcattttaaagcaccaagctccttcccaaggaacagtttttccttctcttcagatagtaaaactcactggccataagagcctgtgatccacaaaagacaggatagatttttattacctgctgtaattaagtttagccttggattccaggcccaaagatttataaaatgttaggctttaaaccacaaaaccaaaaaatcaagccattcttgattcctctcaggagaaagaatgttttctaatcccatgaggaaatcccaatcagacatactcaaattggatcacactttacatttaaactaacaataagaacaacaatagaaataacaatcatcactaatccagatccagttgttctttaattgtaggccaaatcattctctgcagatcctgaagcttttcaaaaatgaagaccaatcctgaaggtgagctgaaaagtgttgtgagggttccttcactttaatctactgcatttttatgcagtgaaatcgggataatgtggaaatcaaggtcgcttttgatggaagagaggtgacaaaaagatatctagagggacagaaggaaagggaacaggagtaggatggccaagaacaggcctacttaatttgacttgctaatttcataaagagactctgagcagaattgcaggtggattatccacatacaatcctcaggcctttctctgcactttcctatgctacatggtctttccttcccacagggatctttctctggtattgtctatctccttagcaatgagagaatggaggctgttcaaatcacctgtcatgagactgtcaccctactctctaggtatggcttcacctaaaatacaattataaacatagaaacttccacctcacaagtatagtggtgatagcaaaactcagagcatagcaaagtgcattctagatgccaacatagaaattatgttcattcagtacattaaacagcatttgtttccaaagaactcaaacagaatgacaaagaaaccactaacacttcactagataagcaaatatagcactttcaatattatattaagagatgcttatcaagaacttgcaaatttccttaccctttgttctagcaatttgcatcagggaatctattctgcaaaaagcagcgactgcatttttttgcataaacgtgtgcattgcagaattatttagatggacagagctttagaaacaacctaaatatccaacaatagtaaaagagtaagtatattaagatatttacatacggaataggtggttgatttacaaagggctagtggaatagaaaaaatttctcatgttaagatccacatcaaaattttttttgtttacaatatgcacataaaagattaagttataaaatcaagatttaccaaagttgaaagcatacattttttcactctcttataagagcatatttgcatgttcctaaaagaatcaataaatatactcttataatccatacatgttgggtatttacgtgttaaaactgaaagtctaatcttgtgctgtctttgaaaaacggctgtgttgctgtggctaaagaatgctttacagaaaagaagcatggtatactaatgtgagaaaacgtgctttgtttttaaatgtgatggttttcttggtgacattttgaagtcaatcttttctctcttgaatgacagaatttctatattaagagagtatgtggagacaaatagtgcctctcagttgcgcaaagaagcatatttagtatccaactacagaattccacggaaattatagaatcttcagtccagatttaggtaccagagttaagtagaaatggttatagaaccagtcagtaagagtatagcatatacgcagaccgccacacagagagtgaggcatgtgcaagagaaaaaaagtaagagtgtaggaaacaaagagtgcaggaggaagaagagagcaaattggtaatgattctgtaaccagagaagcactggcatgagtgaataactcaactgtaaagaagtacagaatggatgatagatatcccaattaccctgacttaataattacacattctaatactcatatgaaaatatcccatggatccccaaaatatgtacaactatgatatatgaatacaaattaaaagtaagtacagaataagtcatatctatcatcacacatgcagtatctccctttttaaaaagttctcaataaaataccttaatcaaatgtggctcagtaatagtaacactgaatttagacaactttatcaattatcttatcactagaatggtgtacaagcgtgatagtctttgattgggcatgaccaggaaaaagttgagggttacaagactggtgaccctcaagagaggaggtaacatttgtcggccttacaattctcaatattgatgcatgctgtgaaagtgcaagacataagttattctcaatattgtgagaccatcaaatgttacctcctctcttgagggccaccagtcttgaggctctcttgagaacttccttccaatattagtccataggacctcctgacacattcacaagagaaacagagagcaagctgagtgacattatttttattctcttacttgagggaatatatgtaatttagaatggattagatagctctcctgcattgctttattgaagatatgtctggagtctgcagtcagaaattagtgaagtccttccttatccatctgaaaatttcaagtttctctaaaattaaaacaagaaatagaaatagtttaaccaacgcagagaccagacccaacacactaatgcaaatacccctttcctagactctactatggtcgattcacttttccttatggttcacttcatggcaaagctgtaattataatgcttagaaatgttgacctttacttaatgactgactctctcatgaccaagattaatgatttgaaagcccaaatgcagatgctaacaaaagataaaggtgtatctatcacttaatgcaatgaaattttattcattaaagaacaagaaacaaaggctgattatatcttccttcttataagctatttaaaaacaaacaaacaaacaaacaaacaaaatgatgtttcgctgtgttacgcaggctggacttaaactcctgggctcaagcaatccttctgcttcagcctcccaagtagctgggactaaaagtgcccaccaccattcccagcttataaactacttttaaatagcagtcattctggcttgttttcttgcatccagaaatgaattcgactggtggctcattgtttctttttccagagtaacatggtctcttttcctttggtccacacagatcctgtggatcaacttcatgtcagaaagcaaaaagtaaaaataacaccttggagagctctcactcatctattcgcaccaacctaatcacaatgctactgcttccaggatgaccaggtaatgagtgtggtctatccaacacgaggattctttccaaggcaatttggagcaaatcaactaggctaattggtaattcaagtttttatcccataaaatgactgtggcccaagggaatgtatcagaaacctgtgcacaagagtttgtattagagttgtttattaacatggggattatcttcaaaccaataataaaaagctataattgactctttgcaaatgcataaatatgggagcaacagtgtgcacaggttattactaaactggaaaagaattttaaacatttcttgtaataaataaatcacctttaatagtgacaaattgtagataaattgcataatgccaatgtatatttcaaggtaagaactaataatacatcaattcttttttgttcctttaagattagaactcataaaccccacagtgcactgggtacaaaatcccattgaaaactcagaaatgggactgatgggagaactgaactcagagacttccacaactcggaaatatgttcttaaaaagccatgtatctttttatcttgggcttctaggcaactagcacaggtcaagataactagcataaaaggaatcgggcactaattctgctaccatcttggtgtacgatctgacgcaagtcaatgaatcactatgcatctcaactcttagatctaaaagacagaataatcaagaattttataagactccaatgagacaatttataagaaaaagcattgaaaataatgcatgctgtgagagcgcaagacataagttattaaagggctgatatgtcaggaatatcagtaagtttcagaataaactgttacggtctattcttgatttggttaaggacatgagggtaaatatgcttatgctattccattttatggatagcagtggtgagaaccactgtggccaagaattttgtcaattaatctgcaaacttttctgaccaatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactctatttagtggtgactgcacatagttcattttttaaaatctcgctgcacacagcctgatcctgtactactcaaacatgtcaattgttatgattcattattcttcaaaggcctcaagttggtactcaatattccactgggagcttggaaaacggatctgtcccttcactgagttattaggcaagtttcaacacatcttttcatcagtataagagtctacagaacctagcctctgtaaattcagagaaggggccttgtattttatggcacatggaaaggcgttagtcacacacaacttgttcccagtcataggcctctgttcaggctcctctcttctctaggttcccttagccttaccagcaaaatccctagacaaatcttatttcttctcagacccagacagagcctcagatcctgtatgaagactcctgcaatgaggggaaccatcttctccactggaatttgtacagctgttgtgaggctcctcttctctctcaatatcgccttttctactgccactcctttcttgttaaggtactagccactctaaccacaccttctctcattcctataaccaatcatttttaaaagtctggcagaatctctgatcccaacaccttcacagaaaaaaaaaagtaaaaacaaacaaagaaacaaacctgttatgcattataggagtgattttcaattgtgtgtatgtggggtgggtgtgtcttgatgggaacatgaaaactccgaggcagatgtggtaagcagatgggcggggcatgtgtaatgtgatgagtccttccagggtggccttatctaccttgcttatagccagcaccacaatctattcacattgtttgtgcctcagctcaggagcttcttattgctcactcaatacctcccaaatgattttctcacctacagtcttgttctctttaaccatgacccaaaccaaccaattaattctctaccttgcttgctgaatgacctgtgtaaatgcaggcctaattctgtcaagcccttcttaaatccttcagtgtctctctatcgccttgaaggctaagtcaaacttcccaacaaggttgagtaggctaccattcccgtttgggctttctagcccctttttgggtttattttattttttatatgcatttttttagagactgggtcttgctatattgtccagtgcagtggctattcacaggtgttatgatttggctgtgttcccacccaaatatcatcttgaattatacctcccataatcctcatgagtggtgggagggaccaggtgggaggtaattgaatcatgggggcgagtttttcctggccgttctcatgatagggaataagtctcatgagatgtgatggttttataaagggcagttcccctgcacacactctcttgcctgctgccatgtaagatgcgcctttgctcctcctttgtcttctgccatgattgtgaggcctcccagccatgtggaattgtgagttcattaagcctctttctctttataaattacccagacttgggtatttcttcatagcagtatgaaaacagactaatcaattttttgtgatggttaatattgagtgtcaacttgactggattgaaggatgtaaagtattgttcctgggtgtgtctgtgaggatgttgccaaaagagattaacatttgagtcagtggactgggaaaggcagactcaccctcaatctggaagggtaccatccagctaatcagctgccagcacagccaggataaaagcaggaagaggaacatgaaagaattagactggctgagtcttctggcctccatctttctcccatgctggatgcttcctgccctcaaacatcaaactccaaattcttcagcttttggactcttggacctacatcattggtttgccaagggctctcaggtcttcagccacagaatgaacgttgcactgttggcttccctgcttttgaggttttgggactcggactggcttccttgctcctcatcttgcagaaggcctattgagggagttcatcttgtgatcatgtgaatcaatactccttaataaactcatatatatatatatgtgtatacacacacacacacacacacacacacacacatctatcctattagtcctgtccatttagagaaccctaatacaacaggcatgatcatagcatgctacacagccttgaacttctggactcaagtgatcctcccatgtcagtctcttgagtagctgagactacaggctcatgccaccatgtccagctctaagaggtcatgtacttttttaaatttttttttcaacttttaatttttaattcaggggtcacatgtaaaggtttgttacttgggtatactttgtgatgctgaggtttagggtatgattgatcctgtcactcaggtagtaagcatagtgcccagtagataattttttcaactcttgccccattccctccctctccctctaatagtgccctgtgtctaccgttgtcatctttatgtccataggtacccaatgtttagcttccacttatgagtgggaacatacggtatttggttcactgttgctgcatttattcacttaggataatggcatccagctgtatcaatgttgctgcaaaaaacatgatttcattcattttcatggctgtgtagtaatccatgatatatatgcaccagattttctttaccaaagatactcttgatgggcacctaggttgcttccctgtctttgcaattgtgaatactgctgtgataaacatgccagttcatatgtctttttggtagaataatttattttcttttggatatatatcctttcctagcccagttttctaagtgtcagccagccctgcacgattacttgaagttctcaaagtggtgcaagcttcttgctttagagcatctatacagttgttgctcctggctgattcctgttgtcccttttataactaaataggctacttaccttttgttctttaagaccctcttcacgtatcacctcctcctccagggctctcttcatctctgaaggctttttaggagcctcccttcattttctttgaacattaatgataccacagtcctatctcaatctctcacacctgtctactctcccaagtttctgtaagaatcgactagttcctgtaattgacagctatatggtgttactattaattagtcccatttgattatatcatttcctgacagtcccaaacactctttggactgtggattttcaacatttgtatcagacagctggtcaggtctacctgctattttaccattgcttgcctgtaatttaatttatcttggcctcaattcctccatctgtaaaacaacaatgactattctactggtttatatggtgactaagtaagataatgcatatacaaaatacagcttaattaatgcctaatactagtaagagcttaattaatagtttctcttcttccccctccttcaaattattattattattattattatgctaggcacttaataaatacttgacacattgaattaattagctgagagctttttatatctaggaaccaaatttccacttctgctctccagccaacttgtggaaggtgaaaggaagatggtcagcatcaaaagattcctctttctagcacgtggcagagtattccacttttgccttgtaactgccattgaaggtgatatttcacctgataaagtcagttatgagatctcccatacagagtaatgaaaaagcctgtaacagctagtgatctgcctcccctgctgttgcctccaccgaataattttgccataaaaaataaaggggacatctccttttagtgaattatgacaaattttaactgacttatccctcttggaacttaggagtgtcctactttctcctccaatgacactcccactgagctgacatgtgacacatcctgggaatgcattagaactaaagagaaagttaagactgtgacacatccgttggccctttttttttttttgctaaaggaggaacatccctcctcccttgtctcctcagtccatagctctctgttctcaggatctttttaattctactggccgggaagacatttataggcaaaagcccctgtagagcaacatatccccctctctatcatatatacttctcaaatacctactacatgccagacactgtggctctggggacacactgatcagcaaacaaagcccctgcccttatatgattatagtggggcatgacataaagcaaatgtgttcctaaaaaattccaagttgaacaaatgacattcataccatactttgcgtatggtgcaaaccatatgtaccaataatacatgacatctaaggctgaattttaaaaataagtattcttgttagaggccagtcatcccttagcaactgactatttcagctctggctacagggaaggtgataatgagtaacacatattgaatacttaatatgtaccagatattctgctatctttttcaggtatttttacttgattatcacacatctaaattccccatgtggttatatgcttatcgttatacccattttgtagatgaggaaacagagcagttaaacaatttgctcagccatattgttagtaagtggccttgaaccctggcaatagagcacacgtgcacagacagagagattatgacacattgtctccaaaggtgcttcagaaaatcctaaggagggagtgaatgagtgaggatcatgaatgtgaaaatcaaatctacccacgcaacaaaggaccactaaattgccaaaatgctcaagagcatgatttactgtattcttcatttctgtgtaaataatgaaaataaatctctcggctcccaagaggagcacatctgtaatagttcctgctgaagatgttaaagatgtgtttatggaatttgcagaatcacttccttcaaagttcaatggtctataagttgctagtgttattgttgttaaaagaaactgaacgcttagtactttctgcttcaatctcaggttgagatttgtaaggaaaaccagatatcagaccagctcctatggaaactactctgtccaatcaaaagatatcctctttccatgaaactaacttaactacctcacaggatattcgaagcacaatacataatgtgaagggggaaaaccttactttccttctcctgttctagtacgctttaccagatgctcctgtggccaaaccctaattgttcacttcaaaacaaaaactacttaagcttctggaatgtaacacatctctaccaggttaaccattaagagacggagaggcagaggcagaggggaaacaggagctcctctcagacatcaggaagacaaatgcgaattgtccctacaaaagaaaaaagatcaccacctacgtgtttctctatcttctctcacttttctctgtttccttgtcatccctctttctgcccaggtaaagtggtggtggagaaggagaggaattccagctaaacagtgcgttggtatgaaccgtaggctagtgagccatgtgcatgctccagggacagggaaactgaagagagtgcactataggacaccaaatgcagatataatcaaggcttctttctacatgccgcaacatagtcaatttgaaaataagcatatccagaatggtaaagcacttgcgcagtaattcagccatgctccttctaagtatgaaaatctgaatatcaaagcacggtaaggagggaagcaggtgaaaaacaataataaaaacagtgagtcagcattttttgaagctatcagaagctcaacagagctgaatctattatgggataagaatggaaagatacaggtggaagaattgacatacagcagcaatatcttaaattaactccttgctattgaacacatgagaaactatagtgaaaagtctcagtgactgattggtttttatgcctagaagagaaagcaaattttgaaagtcctggccctttgcatttaggtccataattagacaattagagctcatgtactacaacaaagctctcaaacaatcatgaaacacagccacactcattttaaaagaagattcttaagagttaaagaagaccttttaaaaaatacattgctttcacatttcttccaagtagcatagaaatcagggaggaagaggaaaaggaggttttctatccatcagaggaacaggaatggattttggcatgcttggctaagcattctccccatgatttatggtctgaggtgtcacttacatggatgggatggggtgggagtggaaaaactgataacatgatctgataaacacctgtatcaaaagcacctgaattgcttgcaaaaatgtgtatttctcactgaattctgaaatactgaatctcagcagaaaactcaaagaatcttctaacaagctcctcagtgattggcaggagctttgagagaggcaagggctgagtaggtaggtggggaggtttgaggctgttgggcaaaacagggttgcatccctttccttagacaacaaacagggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcggcaaataagtcagttaattacaaggagccccgtatgctgaatgcagttgcccaggaaatttgcttaggtcttgcttagtcaaatttgagagacagctcaactaccatacccatggggaaaattgtggacattcttggagtatatgccttaaataccatagttgaaaatgccttaggttgtgcagtggtagatgttttttaatgtactaatttaattgatttatacaataatatatctttattattgcacttagcaccttatattgcaattaataagttgtatattttctcccccttattgtctataaggtataaatttgactacaattgaattcattaattttaaaatctaaaaatgcccagtattttgtgtgatattatatatatcttttgtaaatgcttaccaaatcaatccgtccttctagatttttatttggtgaaaggaacttgtatcagacagtgaacactaatgtagtgaatcctagatttccgacagtgtgctaagggactgaggatgcaaatatgaatagaaaacagttcctgtccttgagaaggtcatagtcaagttgacctggaaatctctgtaagtattataatgcaatggtaaatacatttgctaaacaatagttctttaaagtacctaatttgctgaatacattcatatttccacatgttgagtttgttcaaattcacctaggcaatttatgttaccaatgcattttaatcctgggttatatagctaataaaaataaggacattattaattattttttaaattacattttaatatttaagtaatcctaattaagggcattaaacatgtaattaatgtttgtttcattataaacttgtctaagcatatagctgtacgctaaaaacaaatacaaattcagatttaccactgtgaatgctaaactttatcaaatagtacaactctggccgataatttatcatattctgcatttgttgatataaagacaaactgcaaaaacactaagtgtatttctaattataaataggatttctactcaggcctagggacagtgagtttttataaatgtgcaaccaaccccttttcccatgagtctgactgcagttctttctccatggctgataccaaggaagaaatgttgagactactctttgggattctctgcagtgtatttgctaaccatgtggaagaagtatgtgggatattttaatgaaaagggcagtaaagttagggataaagagacacaccttggtcaaaccaggtaataactaatatgactttagaaaagaaagcaacttgctctattgtgcaggctggagcgcagtggcatgatcacgactcactggagcctccatcacctgagctctagccatctttaaacctcaacctcctgagtagctaggactacaggtgtgcaccctgatgatttttttttttttaattttagtagagatgaggtctcactatgttgcagaggctggtcctgaactcctgagctcaagtgatctgcccatgtcggcctcccaaagcgctgggattataggctaattagggtttctatttcttttcttacaaaaggaaaacatttgactaggaagtctctcaagtcatttcttgctttaagtctatgattcagtggtcagcagtaatctcagagaagatgctatgtggaagggatagctggttgcagctgggtcaccgaaaatcaccacgaagttcatacccttagtaaaattattttacatattgatagctcacaactccctcaacctcacactctacatccactccccccatcaatttccatacatgcttttgggttatggagtatcagcaggcagtgacaaccaccacgaacaacaacaacaacaacaacacacacacacacacacacatacacacacacactctgaacttgaaaacgaaaacttcttgggattttcagggcatggtctcagctacccagcttcctgggaaataaagaaagtagcaagtgttaacacctcatttttacctatcaacagttacagaaaaacatgtaaattgttccttatacatcaatgtatgagtttttgacaatgctgggggataaagctattatttctgggttctgcttaagacacgctcctttgtcctccctaccactcagatatctatagttcatacagtaccaaaaacacctctttccacctagagggctcttaaaacctgcagttaagcaagagcaagccaaaacaagtctatagcatcacagatgggttatccaactcaatcacagacattcccctaatctccagcaaagaaacctgctgtctctctaatgcactaacatcatttccctagggcaaggtctgatttctctgagtatattattcatagaaatattatacattttgataaatgtaaatagaggataaactcagtcaaaaacaattcacaggttagaggaggtttaaaagagatgggagcgagaaatcactttttcctgtatttgttttcccaaggtttctcacccctctgcagaatgagattctaggtttagagacattaggaaaccagtaaccacgggacccgttgcctggaaacggcctgattacaacgaactcactaggctacaaggaaattctacctgatcctttaggaccatttgccaagcctcattatgatgataaagaaaatttatactttcataaagccttcaaaaattattgccatgaggttctgaaaaatctgagcatctgctttggggaagaaatgggaaattaacatgaccatctagtgtcaaaaactgacagcctagacaaaataaagaaaaattcgttcagcatcaggcgtagaattcagaaatcaaaaatccaaattcaatgctgaacaaataatgtttgggaattgtactgtctgccatgggggtgagaagccaaggcagccggaaaatcactaataaggggcatttgtattctgcagcagtagaacttcacttgtgcttccctgtacatctaagaagaactttcaatccaatgctgccattaacagctgctttgaaacatacgccatttggttttgttgcccttgacaggtgaacaagatttgtcagggaaataacattataataatattgcagaagtttaacaaattctaagaatgtctataaatgtttaagacaattagtaatcactctgagaaaacagagtctattttacactttagtgaaagaaatttttatagctaaatgactgtaggtatatatatttgtgtgtatatttgtacacgtacataattttatattttatatatatatatatgatagatgatagatagattttttcccctttcaagaacaacaggagttaccaaatgcatcagtgaattctggctccattaaaagttttcgttgttgttgttaatgatctacttacagttacattggactaaggtgcgtctcacagggagctcaaatgtgactttggacccatcttaatatggactttgccattaattaggtctatgattaatttttagatcatttatcataatttgctggagcataaaatgcaaatttcagtgaaatctaaccataattgcttacaattaaattttttatatctattgtaggaaataaattcagcatattcttttaaattttttattactatttttcaaacacttttttgaggcatgattcatgagtccattcttcatagataaatgctcaacattccagggccacagggattaatagagactggtagagagagagtaaagtaattagcttaaattttgccatagatgctatgggaagcaagccattttcactttaaagggactatttttccatacttcagatattcaatacatatccacagtactctcaaatatgattccagggtaaaatgtaaggcctctaagccctaggtttcaaggaatgtatcttaattacgtttgaaccctcagtacttatttcaggcctagcacacagtggatactcccaaatctctgctgaactgaaccaggccatagtatcatcagaggaagtgatattctactttagagctaactgagacagacagggaaataaaaaacggactgcagattgtactgaagagagtgcctggaaggatgatggtcatagattacatggagaaacaactaatgtcagaacaagaaatcttatgatcatcatttgacctctaccacccattccccatgccagtcactctatatattaccgtcaggattattctcccaaaacgcaaaatcataacactattcaactgcttgagaacttacaataaaaaaaaataaattattcattgcaattatctttgtcttcaagcaacttaacaatttggttgcctagatagaaataacacatgatactttttataaaataggaattgagagaaaagtcaggacagtgtgagctaaactgtcagtagaagctgcctaatgaaggagggactggaaccaggtctatttatttgaaagaataaatagtagaggaggaccattccaggacaggtaagaaacaagcaaaaacacagaggtgagaatttgaatagtacattagaatagatacaaagatacatttggagatgggttgcgggtaagaataccagttttggctggaatcttggaagtctgaggcattttccgtgaaggaagtatttaaaaggatgctacgagtttccaggaatattcatgaagtgctactggtgaaatagatagcatttgtgatgaacctagggacacactgattcattcatttggtaagtgtttttggaacacctgctatgtcctaaccactagagataaagcagtagacagaattcctgccctaataaaacttatcaggggtgagagtacacaaatgataacaaaacagataagttagtatataataaaaggtcaagtgccatagcaggtaagggtctaaagaatgggagaatgtattctaaaatattaaaactttaccgtctcccaaaatatctagtacagacatgggcatgcaatagaaataccaggtgactggagtactgcctgctgaatacaagtcctggggttatgggatacagattttctcctaataaaacctgaaacaatcaatcagaactctatgaggtctccgatgtgcttgcctaacacataaaaatgcctgggcgcaacccaacctcacctaaaatgggaggatatctgggataggctcctgcagcatacaaagttggatatattgcagggttttcgaaattctttccacattatctaggatgagctgctgataataaacaaaaagttttcattaaatatttgttagataatatgcctatgactgctaggtgctataaagattaaaataataaaagatggtcatggcattgcctttcttaaaaaaaaatcaaacataaaagtaaacttaaaagtcaggaaaagataagtacagtaatgacatcaaaatgagcttggttttacaaaaaaaaaattgtacaaaggagttcaggagctcctgtgatatatgaaacttgaaaaaaggaaggccacttatataaatgcttgtgttttcttgagtctttgagatatttaaattctatgggagcaagcattatgaatgtgattttcaaattacaacacctaatttgttctgacccatccttggtcactggttgaattttttatatctcaaatgccatcctcaaatatgggccaatgtccacacagaggtaactttccatgtaaaaaattggcaggaacaagtgagaaagggaggtgcttacactgccctttctgtaggacgtatttgcactgactgagttaatgtttatgggctgtagatattcattgagacatagtatggggtggctaaactcaatgccctacaaagagaaacaaaaggaggagcctcgtccatcatattgccaataaagagcagtaaaattacttgacaatataaagataatactttgctttcccactgtgcttggttcttgctaaaatgttattaatgaaaggaactattagatcccagtaacaagctgtcatacaactactttacctacctaatttcctttcccactcacccataatatttcctgtttctatacagcagtcatttggactctacaatatttcaatctgtctcatctccattattggtagcactactccccaatccacactcctgctctgtgcaaaactcctgtctcctcattaattctatttattcaactccttcaacctttgtccagagggtctcttttcagatcagacattctgttttgtttgttaatttatagcttttgacatttattattatcttccaatgagacacagaaagaatataagaagttaaatgttttcacaagcaaccctagattcctgtgtccctttgcgggggaggaaaatagaaagaaataaaagctgccagatagaaggcctgaaataaatgacctgcaccacccataggcaaattctacctctttgtaaagaatgtttcataggagggaatcaataagagctgaatatgaaacattggtgcagtgcactagctaagttcagtgaactcccaagctaatcctgtgttctcagaagctataagcgccaatctcttcacctttgctcagggggatgagctcaccacagaaactggcctgttttttgacctcaaaatccagttgggacagggttgggggatggcagaagcaatgaaagggaaggtttccaggccatttgttctaaactgaggtgtgctggcagaagcgaaggacaaggttgagtctccatggccctgagctgggtcacacagctggaatcacactttgctcaacacaaacgtctttcactttttcattcacccacaagcaacacaaggactgcaacagaacactgatgagaagaaacaggcccagcgccactggtcactgtcagtatctaggctacctagtaaagcaacccccacacgacccggatgctaaataaacgtttacatcagctcatgtttccctatgactagctgatcagtatatcgaattgaaatataataaacaccaaaaggaatgctggcaggaggctcagtattttcagtttttgtacaggttttttgaaaatcacatcacatttgttccctttaatgatactgttgtcttacagaaaaatactcattcacgtattaaaatttcatcaccatatctaaagcgacattcctttttaaaacaacaacaacaaaaactaaaccaaacttactaaaaagccccaaatgtctacactgaagcaactcaaatgaaatggtctaatcataaaattaaacacattacagatgagttgatttgagggcatttagtacatttgagtatactcgatatttcagtttctttaacctacattccctaaaagtaacactaaacagtggttctgtgtatatgacacagtaaaaatgcatatatttatttctgaggctgtatattagctgattgtgaatcacccttgaaagtatgttttataaaataatgttcatgcaaattctactaaatgtatggtatactttatacaaatattaaatatgaagggaactggtatataaataatcaattgactagactatgcatttaatatgtatttcatgacataatattagcttttataggaatcactacttgaaaaagcagaccattaaactgaatttgagtttcaatgactcaagttctagttccttttaaatgtgtctggacaatctggttgtatcacttgcttctcatccataaattttttcttaccatttatgaaatgcttgttatgataaaaattattataccacatatacatttctattcccatcccaatcaccaatcgaatttctaaactatatccctatgatctaaaataaaccaattaaacaataacaaacaaaactttatgcatctacttattcatactgattacatatattatttttcttgccttgtctttaccactagtatattaattcttaagcccaagaactttgcattcctactgctctactccatcctttgctttaagcacaaattagaaagaatgtaaaccaacactataatttgtctcatgatagctccaagatggtctgatttactgtgtggtaagaatatctcctatcctgcatttcaatctccatccaggccttcaaataatactgtctatcagttaatatacagcattcccagttgaatatgattctctaacagtagcagacagaattgttctctcggtatcctgtggggcctaagaggacagtcaaaatctcagcaacactgtattttccttgcttctgtgccattctaacaatttcttcccctgggaaagcctcatcttttccttagatttgtgtttctggactcactgatgaatttagattctattcaaatgtgctcgcactgctatgttctattatgatctggaaaataactattattgttagcaagcaaatgttagagtttttattccactaacacatgctttgagaatccctaagttcctgtttatgactttgcagataacaaacaaaactataaagagtgtaactacttattgggcctttaaagacacgagagataatttattagaggacacgctcagtgttctgtccaggtggttgctatcaattacaaacagaagtcttcccaaatattcacttaatgaataaattgaaaggaagatcaaaatgtttttcatccacagaaagacctttgccacagcattgatatgctggtacttttgtcttaacattttggtctcttataatctcttgtttaaaagtcaacttttttatgtaaatgtctctcagtttatccagggtgattcttttctgttggaatgagaagcattatctctaagcatgcatttatgtgttgtttaattgggtgtggtgtggttgttggctctgtgataagaaagcgtcacagtctccgacctctagatgcttaaaatctaagatgaagtaaatatcccaatatattactgtggacccaaagcataatgggccatttaaaatcattctatgaacaaatcgactgtcattttgacagtactgagaacaacatatatcccttcacatttcagcttgtgttggatcattaggcacaagtttgaacaattccagggaaaacttacaaacacattttgaaataaaatttggatgtaaaatatcaagacttaacagaaacattttacagaatgatttacttcacaaaattatgtggtccgtacttctttcaaataacatattttctgctggatttaagtaagcttaattgacatgttatcatttatatagaaaattaacatgtccctgatttgtcaggtacaacaagaatgtacaaaggaagggccacatatactgcaggaattttaagctattctcttatcttttatttcagagcattcataatttttaaatgttgcaataaccttttgaggcaatactggtgacttcttcatttgactaaaacatccttgcatatcaacaattgaacaattgaaacactttaacaaaatctaatgtgtatatatataatattatatgtattatatatgaaaagtatgcatgtcataccatacatatagtgagatatatatatatatatacacatacacacacacacacacacacacatacatacttatgccatcagagaacatttcatttagattagtatgaaaattcaaaaaggagttaagtctcatttttatggagctacacccacaaatcccccaggctacacttagttaaaactctgaaagaaattttattctgagattgagctcctgccacatcacactgtcaatatccaatattctgaagctacaagggccagtgcccaccgatcctagtcccatttaaggaaatgcaatgcaatctaatgccagttctcaaagcacgtaagtacatgctgaaatcaaagatttaagtgaccatttattttgtcttgtatctgcctgagaaaaccctttgccagccaattttctcctattagaattagctttcaaagttagaatgtcatttgcatgcttgcagacaaagctaacaatttcaaatcatgaaaatgtgtattctcagatggtgaatatttgcttttttaagtacagagagtagaaaccgagctagtcttactagattttatatattgcttaaattaacggccaaaaaaagcctccaaggggtaaattgcctttttgtaatattacctttaatttcttttagcaaatgggatatgaggtttaagtgggttgaagaaaatcaagtaaaatatttatggtatacaattttctatggtcatatgcctaaaagcaaacattttgtggttagtttactatgaatgtaccagggctagcaagggagtcttttgcaagacagttgatttttagaaacgcttacaggttgaaactacaagctcctaataacatttaacaatcagaattgctttggagaccagcctatgttggctaacgctggctacttaggctctgcaaagtttttgtaactattttggcaaccaagtaccataaaaccaagcattccattttacatccaatgtgtctgtgctggcattaagtaataccaggagagtattttaaaggttcaaggtcaaatacttgatattccattgagtaaaatataaaagaaaatactgcacatcatctaaatatcctaaaaggctaagttctaaccagtataagtccacaagggacagaaaagtagcatgatgaaataaaaaagaacactggactgagaattaggccttgggcaaatcaaatccattctgagtctagcttctccacttcttcaaagagggtaataatactggcttcactgacctctttggataaaagcctgcatgtagaaatgcttaaaaatgtagacaatttaatacaaatattagataatactatcatttccatttctcctgataatcatgcagcaggtctctgaacaagacctgtgtactgtgttattcataacataacttgagaagaggtggtagtttttacacacctcctcccccccttttttctttacacttgatcagcttcagagatacagtcagttactaaactcctcagacacttttagcagcatcagaagcagctgccacttgcaaacctgtcagattccacagggactaaggatgtaaaaacaatgagtcattacaggtgtgtctgcctttttcattaaaagacaaaatgaaaagaagatgaaattcacccaactcagtgtttttaaggcagaaagtaaagagatcaaccaggaaatactttattcctttaattcatatgacagacattcaaatataacatagtaattgtttttaaatagactgttactgtgctgggtgctcccccagactacgaaaaagagtgctatctaacttcaaggaacacactgttcgagaataacaatatggggcataatggtagcatacaattaattctaattccaggtagaaccttggtgagacaagaggtagtaagaaggccactggaatgaacaaaaggaaggtggcaggatccttaaaaggtttaatgaaagagacagagatgacatttgagataattttgaatgattcctgggatcctggtaggagaaatatcaatgaagacagaaactagaaagagggatatgttcaaaattgagaagtctaagttgtttcaagaatatcctgctacagtttccctgtctacccaaatgtgcatatgtttgtgcaagctgctgatgttcgtttgttacaaaggtgacatgaataacctaaatttataaaacatctttaaaactggcaaataatacagaatctctatggattacaaataaaacatttactatacatgtaatcatgttttagaaattaaaaataaattaaaatatgcaaaacaaagattacatataatcccaccacccagggctattttgatttatgccttgccaagactatgtctctgtacctatatacatctacattttttttcttcttcttttaattatactttaagttctgggatacatgtgcagaacatgcaggtgtgttacctaggcatacttgtgccacagtggtttgctgcacccattaccctgtcatctatattaggtatttctcctaatggtatccctcccctagcacccctcaccctgacaggttctagtgtgtgatgttcccctccctgtgtccatgtgttctcactgtgcaactcccacttatgagaacatgaagtgtctggttttctgttcatgtgttagtttgctgagaatgatggtttttcagtttaatccatgtccctgcaaaatacatgaactcatcttttttatggctgcatagtattccatggtatatatgtgccacattttctttatccagtctaccactgatgggcatttgggttggttacaagtctttgccattgtgaacagtgcagcaataaaaatatgtgtggcagggcgtggtggctcacgcctgtaatcctagcactttgggaggccaaggcgggtggatcaccaggtcaggagaccgagaccatcctggttaacatggtgaaaccccatctctactaaaaatacaaaaaattagctgggcgtggtggcgggtgcctgtagtcccagctacttgggaggctgaggcaggagaatggcgtgaacctgggaggtggagcttgcagtgagctgagatcgcgccactgcactccagcctgggtgacagagccggactccgtcgcaaaaataaaataaaataaaataaaacaaaacaaaataaaataaaataaaataaaataaacatgtgtgcatatgtctttacagtagaatgatttataaacccttgggtatatacccagtaatgggattgctggatcaaatggtatttctgattctagatccctgaggaaccaccacactgtcttccacaatgtttaaaataatttacactcccaccaacagtgtaaaagtgttcctatttctccacatcctctccagcatctgttgtttcctgactttttaatgatctccattctaactggcgtgagatggtatctcattgtggttttgatttgtatttctctaatgaccagcgatgattagctttttttcatatgtttgttggccatataaatgtcttcttttgataagtgtccgtttatatcctacacccacttttcttgtaaatttgtttaagttccttgtagattctaggtattagccctttgtcagatggatagacggcaaaaattttctcctttctatacagattgctttgtaatgtggttttttcacttactagtatgtttgaataacttttcatgacattaaatatacaaaatacaacataaaatttacaatataattttaatggttccctgatgtactattgtatatgttgcccatcagtttattttatgagtctatattatttcttatccagtttacctttattttcttgtataaacaataatggcatggtcatccttttaaattaatcattatttcagctctgaatatttatttaattctaggattccagttactgggctcttctaaactgtcttccaaagagttatactgattttcattcttcactaatgggttagccttggtctactcatgttctttttaatgttgaatatttaagttctaatttttcttactactaatatttgaaaatatttttctttgaatattaattatgttgaacatttaaaaatttgtttattaaccacttttttatatgatatgaaatgactaatctccattaaaatgttacaagtctgttttgtgtgttttgttcatctttgcttttccggtaaccatcctctgggtatctttctcttaattaattgtaacctcctatgcatactacactaggacacattcttaggtttaggtgtttatccacacttagtgccatagactataaagggtctgagattttatactacttaaaaggtaacaagttaacctgctgcagttttatgaatgctagcacaaaattccagaatcctaggccagagatgaagttcattacttgtagcaaaagcagcagccagagtatcagcaattttttgtgctggttccataaacctcattttcctcaaggaaatgcaaagacagccatttggtaactgcacttacactgggttgtgttataagagaactctgagctcagagaacccaaatattttataatgggcagtaaatctgactgccctttgcttcagagagaaacattatatttattatactgaagaatatatgcatggagggaaaccctatatctgtgttccaaggccattcaggatacaaacattccttgaaatgaaagtctggggaaaaaaaaaaaaggacgtcaatgtcttgccaggcaaacatgcagaaatgcaaatgacacataggaaattatctccaagcgcttagccctgaacatgtagaagagaataaaagattttgtgaaggaaggaaggagagtgattcaaaggcattcagcactcaaacttggttccaaacttagccttacctgtgaaacctcacgacaacagtaacacaccagccaaataaaaacgtagcttctggtcaagctgatttctaaaaaccagactttctaaagaggttatataaatagtgacttttcactttataaagcaattctctacagaatctttaaatatcaagttattctggtatgattggaaagtaaattcatctaaaaatatttatgcctttttattcagcatattagttaatagagtatgctcaggatgaaactgcctcaattcggatctggctctgtgtgctggttgagttattcagcatgcttcagttccctctgctgtaaactggggatactgatggctattaactccatcctcacagaactagtaaaaggtgcttttgtcactgcatgatacataggaaacattcaacaaatgttagttgttattaattgtattactatcaccgaaaaataagtcattcagttgatatattttcttctgctcttttcctctatgtttacaattaactacaaaatgttttcttttcttgaatgacagggtagatgctaaacaaaagatttaccaaaatctaactctaataataaatgggttaaggtttcactcaaattataggttatttccaaaattaggagaagggaaaatatttttttaaaaaaaggatgatacactttgggaggccgaggaaggcggatcacttgaggtcaggagtttgagaccatcctggccaacctggtgaaatcccatctctactaaaaatacaaaaaattagccaggtgtggtggctcatgcttgtagtcccagctactcgggaggctgaggcaggagaatcacttgaacctgggaaaaggggttgcagtgagccgagatcatgccactgcactccagcctgggtgacacaacgagactctgtctcaaacaaacaaacaaacaaacagcaaaagaaaaggatgatgaattcctaaagctggattgtagcacctgcgataacttctttatttctatacttttgtatagtgtgctaacaaagaacccaaaaataagaaaaaagaaaaaagttgtataacatttaaaggtctgtaacatactattcacttaacacaaacaacctatgaagctcagggatagagtattcaaatatttgtggggggcagcagagggctgcatggcattcctctccagaatgtaatcattatttctgggttatggctggttctaaacctaacagtagtgactcatccttttccagagattctgaagtagatggaaaatgcatacttgaagaaaaggtggtgaacaaagagagagaaagactaataaatggtggctctattgcaaaggcaaagctgttgaacaaagtgggggaaatgagagaactctgtgcaaactaactcatagcattttttaaagcttcattatgtttctgagacttgcgctctgataatgtgtaaagaaccattttttcccctttcaccaccgccccattctgttatctgttacgtctatttcatatttgagacagatgaattttggaaaagttatgtaatttggtcaagatcatgcatgtagtaaacaatacatttaggattgaattctagtttaaaaaatcagtttttgtgttattttcactgtagtaatatagcatcagctgaacttgaattccagccaagtgcttgttctcctaaagcctacatcgcaatctactgaaataattcttggccaacccaagcatcaaataaagaataacctcaccttctggtgctcagccagcatggggattctgttaaattgtgggtgtagctgatattcttggttacctggggatccttctgctaattttggaacatatttggcttttcttaagctctcggtctgtgactttttaaactattcagctgtatcctggctatgtccatgtcctcagagaataaaacaaaatcatagatcagggtattctttttattttgtcctggacactctcattccccagataaatcacaggcacagtcataaatctatggaaaagaacagtacaatttccactggaaaggcattctctatcttttccacattgtatccactattcacagtgaattgctactaagaacatttttctctctagtactctagctacataaaacacttggtaatatacatactagtttattgttcttcacaggcaaacatagtgctacttttccaagtgtgggaataactcattctgaaccactggtcccccaaaggcatatccatatcccttaccttggctttgacaggaattataggagtaatgtaactattatttggtaagaaagctgatagtaaaccgtgtcttctccttattcctgaccctgcgcttatactttgcctagcctcatatttaaagaataccttccacttttctcaaagctacaagtaacaaatattcaacacttcacagagtcaggtccagcaatcttctgctgaggtctaaaaccttgcaaaattctggaaaatggtatccaggtaatattgtggttttgttagttaaaagtatatctgagtatatgtgtgaatgtgtatgggtgggtatgtatgtgtgagacagattggaagtttcttcaataaatatattactttgagtaatatcaggaattgtgctaggcactagggttataaaatatatcataaatgaatcgagtccttaaggaactttgcttgttacacttttatcaaagggtcagatggagaaaaaatgcttttactatgccatcctgagtactcggatataaatgtgcacagggtcctgtgggagcagagagaagggtgatttggtttccagggacaagttgtcttgaaggagatggcagtagaagcaatgaatgcataggagtgaccctggagaagaagaatgtggaggatgttgcaggtagaggaaaagaaaagcatgaaaaaacatggtgagtatgaaaaaacatgaaaattcattattattaattaaagtttgggaagggagtggtagagttaaggctcgacagatattatgatgaagacattatgtaagaccatatggacataatcggaagcttaaaatttaacctgtaggtaatgaggaatcatcaaaaggctttatggctaagtgtggcaaaacagtttgccattgaggcaagctggtcaaggatgaaatggggttaagatcctaggcagggaacaaattagggagctaatgaaagagacagtttccagaagatatgatgaggacctggacaagggtgatggtaatagtgaggacaggaagatccatagtgggggcactgtatacacaatgagatcctctctccaggggcgtctgaaagggatatccatgtgagggttatagatacgaattggaataaactgtatcctccccaaaactcacttattgaagccctaactcccaatgtgactgtttttggagactgggactttaaagttgtaattagagttaaatgaggttataattatgacaccctaatcccacagaatgtgcctttccaagaagaggaagagacactggagctttctctctctgaggacatacagagaaaagaccatgtgaggacacagtgagaaggtggacatcagtaagccaggaaaagcggcctagccagaaactgaccatgctggtacctcgatcgtggattccaccctctagaactctgagaaaatacactttttttttttttttttttttttgagacggagtctcattctgtcgcccccgctggagtgcagtggcacaatctcagctcactgcaagctccgtctcccaagttcacgccattctcctgcctcagcctcccgagtagctgggactacaggcacctgccaccacgcctgggtaattttttgtattttcagtagagacggggtttcaccctgttagccagaatggtcttgattccctgacctcatggtccgcccgccttggcctcccaaagtgctgggattacaggcatgagccaccgtgcccagccccacacttctgtattttaagccactcagttggtgatactttgttatggcagacccggctgactaatacagagggttttgttgatagaagtaaaccctaaaaaacacataaagagaagcaaaagcactgagagaaagtctgaagaagcagaaagccaggagcagacaggtgagtagagcaggagcttctgcttggtagttttgcaggatgaagcagaagtcacgtgggttccctgtagaagggagttctaaagcatgtaatgatggatttctgtttctgaggaggctattctagagttgtgattggatcagccaaactgttgtccaactactattatatcctgaatctattttcattcctgaagtctgtgtggtagccaagtttgtttcttgtttgccttgcttgccaatgtggtataacagccacgcccccaccctcctctggcatcaactggaataggccttttcacttgcactctaaaactgccaaacatcaagagtgggaggaagagatgtcaggatgagcagaatgcaaataatgactgcagactccagaaatcttgggatgagatgttaactatccaagattttatttaaaaaatatgaactgtaatacatatataaaatatgaatattttagccatccacattataataccagaaaacctcttgtgcacataatgagggccatctatgtacgacaggaagtgtggcatgatgccgtctctaaatgaagaggggctctttttaaaaaggcaccaaaaaatctgtttttattcctctttatagcaaattggcttagtttaaatgccagtctataaaaggcttcatccacactctcagtacctaccagttgtgaagaaaagaatgaaggaaaccactgcgtgcactttttttctcagcacctgccaacacagggcttgggttttcggacggaatttcataaatggaacaaatgaagactaatgatcctttctttatctctaagccattatagcgccatcaagtggaagacaagattataggatttagacagtccttgcagaggaactggtaagtagattattcttctacctgcttaaggatagtttcaattttgatccgagacacatctgtgtgtgtctgtgtgtgacacagagagaaaccgtgtggcagttcctcccttttgtcttctacattaatgcattccacctgtgcttttaacatccagatgctatcatattttaattatactgattaatgcccgcataagaattacaaatggtaaaccaaccttccctcaaattagcttagtcaatctgtttaaaggcagcacagtgaaatagaacaccaagctaataacatataaaaaaatggaaaattcttcatttgtttctgtttgagttcttttaattaaaggtgacaaaacagccctttactatcagtgcagcaaatgcaatatgcaaagatgaatgcatttacagctgtagcttgcattgctgttttagcattactaacactgttgggaaaacatctgtgaaaaataagatgacagggaattctcatgataaaactggaaagagatgtcaaaagaaatattgccatctccatctttggagagcttcgtgaagaggatcattgtgtgctctagttgctctgaccggagattccaactctaccctgaaatatcttacagcatctttaaatatctctctgatgggtctctggcaaaacaaaacaaaacaagaaaacaggcagggcgctgtggctcatgcctgtaatcccaacactttgggaggccgaggtgagtggatcacctgatgtcaggagttcgagaccagccttgactatgtggtgaaacccccatctctactaaaaatacaataaattagccaagcatgttggcgggcgcctgtaatcccagctattcgggatggtgggacaggagaatcgcttgaacccaggaggtagaggttgcagtgagccgagatcacaccattgaagcctgggcaacaagaccgaaactccatctaaaaaaagacaaaaaacaaaacaaaacaacaacaacaacaacaacaacaaaaacaagaaaacagaaaatcctttaacctaagttaccaagtaatttaaggtgaaataattttctccttggccacttcttgaagaaaagaaatatgaaacatgtattaaaaaaaaaaaaaaatcagggctttataacaaccctgaaaagaccaggaaccatgagttagttgtttttcctgagtaaggacattgtgcagccgagaggtaaggactgcttttggcactggtgacctgccctgaggctttttcagtccatgattgccaattcttccatctaaaaatggagatctcaccacttctcagcatgtcataaggattaaatggcataatataaatgaaagcatcttgaaaatttttgtatattgacctattgtgagtctgcagagataaatatcccaaaatatttttgtgctccaaaatatgagaaggtaaatacggctttacaattccagttttctatcttgcctgctttattatcttcccctcgccaccttttttttttttgagacttgctctgtcgcccaggctggagtgtagtggcgcgatcttggctcactgtgagctccgcctcctgggttcacgccattctcctgcttctgcctcctgagcagctgggactacaggcacccgccaccatgcctggttaattttttttgtatttttagtagagatggggtttcaccatgttagccaagatggtctcaatctcctgacctcgtgatccgccgcctcggcctcctaaagtgctgggattacaggcatgagccaccgcgcccggcctccccactggttttaagcactttaccaagagctttctgttgagactgcatcaatgtcatgtaacaattccacacaaaacttgtttccatgagtctgacgcttctggacaaggacaaggtcatcagttttgggtgataacttctgtaatatcataagactattgtttctaaggtacctactagtggcaaatgtgtgcatgtgcgtgtgagagagagagacagagagagagagagagaaagagagagacagaaaccctttcgagaaggcctccttaaatcagggataaggttatttctgagaataagataaaaacctaaagataccagtgatggcaagcttaactgtgtgcctaatatgcaccagaactaaaccttagaaaacaaaactgaataaagcatatccctacctataaggagattacaatgtcaaagggtaaaatggataattaaacacagtaattatcacataagcactatgataagggtaaccgaggcattgagtgatcatggaaggtttctcaataaaggtgctacctcgtgtaactccttgatggatgacagggagatggaaaaacatgaggagtaggacagtaagaatgcaaggagcaggaaatggattgggggagaaaagggagaccaggaaaagggatggctaatgtaaggcccgtaggtccaaacaaaccaaaacaaaggcatattaaggaatttcatatattccagaatggccaaggattttaagtgtaattttacattgtgtatacattttcatatttctactatatgcatatagacagctacatctttatatacctactgcttggacccaaaacctgattcatggctgtcagttcttccacatataggcaacaagaaaagggcaaatacaacatgcctgcaatgctcaaacggcttccttctgttaaatgcaatcatgaaatgatacggcttaacataaactcattgaagcttcatctttcaagcacaatgtaaagattctagctctattcaatctcagctacagggcaatcacaactgtaactaactcctacgtctttcatcttttgacaatgaaattaaaatattgcttcatgctatagtaggaaagaacactctaaaataaataatcccaaagttgaaataaaactgaaaataacagcagtgtctttctgagacagtggggcagcaatgttaatgaacggaagctttgctacaaactgaacaaacacgcattgattttgaaggtatacggaaagacgactcagataagctatagacatcagaaatttaagaatcaaagccaaaatgagacaatttagacaaggggcataactatttttttttaaaggtgggggatatgcagagaaagtaaagatgaaagttagcattcacttgagatactcaattacagaaaagtcatggaaatcaaacatgcaagatgtttaatgcacagagtgagatgaagaaggatcatttttaaaccttaaattctccctgctcttagtttggataaagaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgctttaataactcattagagatagatgaccatctcttatatcacttgagtctttcctttcctcaggcatttctagattttgggtcaccaaaacaacccaacagccatccactcactcctctctacataaacataaataaaatcaaaaccaaaaataaaagcagccaggtgtggtggcaggtacctgtaaccccagctactcaggaggctgaggcaggagaattgcttgaacctgggagagagaggttgcagagatattatttctagagattactatattatcctctgagaaaacacacctgcttgtcctttggaagcaaaaccatagtgtaaaatgcaggttgagtattccttatctgaaattcttgggataagaagtgtttcaaatttttggtttttttggatttcagaatatttgcctatacataatgttcacatgggaaatctgggcatgagcagaaaagatatatcacaaatgaggatgactgggagggttttcttccccctaaagaatgctgaataaactgtgtattgtgtgcttgtattttgaccgcaactcatcacattaggtcaagtgtgggattttccacttttggcatcaagtgggtgctcaaatctttggattttggagcacttcagatttcagattttcagattagggatgctcaacctgtactagtagctgatttttaaggtttcctttgttggtaatttttatggaaagaagaaaatctcaacagatgaaataaacagcaactaaaagtggatttatgttgtttttttttttcagcaataagtaaatgcaatcaaaatgttttttttttttaaaaaaaaagactgtcaaaagtaacacatgtaactaagagtgaaatctttggagagttagactttatagctccaagtgaatgtaaatgctttactaacagtggaattggaaattggataagttcccttgagatagaaatagtcaaaatgctacaggagattccaaactgcttgctacaaaaaaaaaaaaaaaaaaatccttagctttgactataagtagatctctagttcttctccatacaggagatatgtggtcttccatcccagggagaataatggttaggtttctcaactctcataacagaatgtcaacatcaccatctgctcatctggctttcaaaggatgcatatgggctcatcttctcgcccagaatctcctcttgctttggggcttttcccttcagtttggtctttagtatgtactcctaagtttgccaaatgcacactggagatcacagaagactttgctgaagaacagcccagtaatgagttgaattcttatctattcagaggtttccgtgaaaaaattcctctgcagcgtattcaaattgtatagccgcaattatactccctggctgtggtaatttaaacgttattttaaaattaaggcctttgttaataaatactgtttgcttaaaggttaaaaggtagaattatacccttcacaccaaattgcagtctccatgggtccttatctgcttgtattaattcaaagagaagattctgggtgtcatctgccacttagagcctgaagtaaacctctaaaagcatacatttctgttgttgtttccattctacatgggcttaaagtatgctttagaaacatacatcacaactgagatgtgcgtgggcattatgaatagttaagcaggagtgcagaaagcaatatggacagaagaaacaaaataatttcctaacatataaataaattcaaaacctacttgaaatgtagtatatcggaagaacattagtcagggtctctataactaattagctttgcgactttgggtaagacataatctctctggatatttatgtaaagctagaattatgtacgagaaaactacagtttagaaggaaagaaagtaattacaaagtaaagacattgaacataaatcttgaattttaccattaattgaataatggaaagaaaatacagactatattattaacttttatttgtctattttctctataaaattttcaatccatgatttagagatcatgtccatcttgatcaccactttatctctggtgtctagtacagtgcagactgaccatttaatatattttgaaggaaagaccaaatgagttttaaacatattatctaatactataatactcttatggtctcattcttcagttatttgctaatataatagatgcatttgtatcctctgtaatataaaaataggaagggatggtattggttgtagttgaatatttaatgggagaaagttaagcctcaaataagaaatttcctgaaatattaccaatgagaaaatgggtataaaaccttccattttaccaaaaacagaactttttttttatcacaagagaagggtaaacggttaattaaaagcaaattagatgaaataagatgatacaaagaaggtatcccatttaatgaacatgttagatactttagagaatttatttaaatttctgaacaactctaaaaaataaatccaatattagttttaaataagaataaattaaaacatagaaaagttaagtgacttatccaaagtaacataagctgtaagcagaagaattgagatttgagcactgatattactggttctaatgtcagttctttttacagtatccatttcacattaattgatagtctaccaactaccagatgtttcactgagcactctttaggaaggaagggaaattaaatattggcattagttaacgagagacatttctttccaccgagtgtaagtaataggatgaagatacattttgagatgatatgatttatccagaagaaaaagcaaagtttgttagaggtctccaatctatgataaaagcattgtgtaaaatacaagaaaagtaaatttcttaagagtaatgttagatgaaagcccatcatagttaatggtataagtaaaactgcattaattgtcaatggtatgaaaatgttcagataaatcatgccaggataaaacagagggcttataaacaagtcttccagttgggtggtcatcaaaaatgtatgaatatccactgagttaaaactacttactctttggctttgccatcttcatgtttagtgaagggaagcagggcgatttttggtgtaacgttccgcttaaccttcactaaagggttaatcaagaaccattactctaaaaactcaaaacaattctgcaagcctttataatgcctagtttatcccttaattttattatcatgggaattaacagaaaatcctcccaatacaaaataaagtgtgttctttcaaagatatacagaaagaggcagctgaagagatgtttcttcctcacattagccttgggcagggtaaacagaagataaaaatccaaagggacatactgagtaagaatagccattgaatgataggaagaaaacctaaattccttggtcttgtggacaaaatagaaacaggaatgcaaaaagagcctggaacccccagaggaccctcagcatgagcagcagaattatccacaatgattctcatgcatttgtactttttttaatcagcaaaatttagcagcttatatttcaatgagagacagcaatgttttcactggggggcaattctgaaccacaggggacatttgacaatgtttgtagacatttttgtttgttacaagtggagtggtggttgctttgggtatctattaaaaataggtagaagcagggaagccgttaaacaccctaaaattcacaggacattccaccacagcaaagaattaactagcccagaatgccaatagttctgaggctgtgaaaccttggagtagaaggagaatcagcatcaaaccctttttcataggcatttttcaggtttctttgttacatccgactgaaacaggcttgactagcaaatttcaagagtgaccttgtttcaaggtgcatcatttgtcggcatcaaattcacatcctctttcttatttaaaatctaccattagttatttctccctcaaaaggcttctacaatttaacagtgaggacatgttatggctgtgaaatagatgtccctatcatactgctttagatgggaaaagaaacattctgcagtgtttataagtcataaagaattctaaatatctcccactcaacacattcaggcaaaatgatggtataatttctgtgctgggtagcactctttcataccattatgtgtcgtgtgaaccaactgtaggtaatgcactatcttcctttaatcaaatctgcattgtaatttctataaaaaaaatcaattaaacacaaggagcaattacttattttttatcacagcataatttactttcccagaacagcagcatgaaaatgtgaagaaagatctcatctacctcagtgtatttaaagtatgcatatttttaaataaatgcgaatggaacactgtcaaataagcaatatattatctctatataattccccatttacatcaactttatggatgggtaatatggcttaatagcaaaagcttaagatatctttttgaaacacaattttttcatagtcaatattatggctgaaaacatttttcagactcttacagtgaaaatataattagacaacaatttgctcatcaacctcatcaaatcactttcataaatgacctacttaggtgtcaaataaacctaaaagaactatattttttccaagccttacaaatccatccttgtttacatttccctacctatctctgtgcattactatcaaggaattttgttaactacatgcttagtagttagtaggagatcatggagctaatctagcatccttacatctgggacctgtagtcttttcagtgaaatctattttacactgagcatcaggagttttttaactttatgtagataagatttacctggagggtttggtaagtaggtttggagagcccccacatttacattttaacaaggtctcatgtgatgctgacgcttgacccataggtctggaaactacccaagaatttaaaagacccaattttcttcatgattcagtaatctgtatgtgctcttaaccactgtgtcagcggcatcagtttattttttctcccttacttttatgttatcaacctctgtgctcatcagttaaactaaaagatcaatccactccaacctggaagattgcattttctttccttcttttcttgcctcttcctgctcctccctttcctttctttctcctcctctttcttctctccctctttctctctctttcacccccttcctcactccccaattccctccctcccatataattctgtaactctgatctctttcaaatccagatgtaaatctcactttggctgtgaaatcatctctgatttaccccagttgatacacaattctcctccatgtggaactgctcagtacttatgaactcacttttattagacttgtttgtactccttgcttcattaattagtaaattaaagcctttgtgtatccctatggtgcatggtcttaattatattattatactatttgttacatgcattttttttttcctttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagttaatttttatacttctttaaaagcctggtttgctctaaaggaactcataaatgagacatattttaaccacttcatcatatttgttggatcactctgttctgaacataagcaattttggaatgaaggccttctggccacacgggtaatatatgtgttgcaaaaagtgggacaccatgagaggtatggaatgaatgaacccgctctctctctctccttctctctacttcaccactcccaccccaacggccccatctaagatctggatgactaatggaaggttaattctctgaggcctaaaggaaaatttcacactttctcagtagttcaaaagtttggctttcccctaagtgataacatacaaatggagtaacagcagaactctcaacattaaggagtttctgtgaaggtgccaaggcatttatttaaaagttgctaatcagatttcaaggcccaaagtcccggctccctcacattagtgatcagatttgttaactttaatttttcataacaatcccataaatttatgtgtttatgagttttttagtattttagtccatttgggctgctacagcaaaacaccttcagttggataatttataaacaagagaaatttattgttctcagttttggaaactaggaaatccaagatcaaggcaccagcaaagtttggggtctggtaagagtccagtctctccttcaaagatggtgccttgttgctgcattcccagaagggaggacactgtgtcctcacatggcagaagggcaagacagctcccttcttttataagagcacgaatcctattttataagtgcagagccctcatgacttaataactttccgaaagtccccatctcttaatactatcacattaggtattaggttccagtatatgaattttggaacaatattcagatcatagcaattagtttatttttaaatttttttcctgattggttcataattagatttattgttatatggaagctgaggctacagacttttttcctctgtatcatagacaagatattagaaatgcagcaacggcatttgcaaccaatatccaggtgtagacagtagttctcaatcactggagatattgctccccaggagacatttgaaaatgtcttatgacacacttgattgtcacaaagatggaggggaggaggaactctacagcatctagtgagtacaggccaagcatgatctcaaacattttaaaaacacagaacagcattcccaaacaaaaaatcatccagcccaaaacgtaaatcatgccaatactgaaaaacacggagctagatcatgggtagactttggagacaggttaatgtagactcttctacatattatctatgcaaactcgggaacactaattaaccctaacacctcaatatcctatccataaccagggtttagaaattattccagcgcaatctctggaaaggaccgaatgatgtaatttatgcaaggtacctatttcaatgtcagatacagagcaagcactcaataaatggtagccctggcatatcacaggcactccataaatgttagcttcccattagttcaaatatattttgaccagaagcttctcctagagaaactgtcattctaagacaaactaacttcagtgaaaatgtccagaagttcccagtgtaagctaaaagaacagttgtcttgtacacaaatatttaggtgatcaggcttctctgctcacataactcaactatttaaatatatatttgatatttgttatttgaggcgggctggtagaaattgtatgctaaaagtagatatttcctatgattctgtagaatatttaccaggagaaggaaagagaatgcttaattattaggaataatcatccaataaactgttcacttgaaagaaaggaataaggagaatatgggggaaattctagttatatataatcacttaggaaactccaatagcagtaaaagcattggttaatatagttgttatgatctcgaaaatgcagaccctcaaaatcccaaatcaatattttcctcaatagtcaaaaagcagaatttgtttaaaaattattttgtataattagaaaaagcttctacctttcttaaccagaaattgctttttaagtctgctttttcaagtattagagtactcataaatatttcagaaaagccattcagtttcagcaccacatgaaaaaggaatgataactttatatgtgtatctctgattcaggacacattttctgaaccacccatcatattccatggacccttaaaattctctggttcagcaagttaacactgcccacttcaccttaacaaagaaaataagaaagctttaggaggcaaatttaaagaaggagaacattctccctgcaatataaagaccatggaggctatacgctgattgatatttctgtacaaatgggtaaagaaatatcagaaatgggtacagaaatatcagctactctactaaagtcaatgccgtgtctcaaatgctgcaaaattacagcagtctgtatcaattctcttttgagcaatagtttacaaagccattcaaaaactgtttaaatttttattaaattcaaattttaacctttaatatcagcagattagaagatcttgctaaaaaataatttgagaagcattttctacataggcacttgagttattggcagcaattgctgaaaagttagcatttttatttctctgttgttataatgtgtctaaatattaggttggtgcaaaagtaattgcagtttttaccattgaaagtaatgacaaaaaattcaactacttttgcaccagcctaataatttggtataagctgtctatctatatgtgtatctaccatctatctcagtatcctctttcttgttggacatgaaaaaaataatataagctaaatttcctctgttcatttatatatgccgtgggatgatactgcattggtaaatgaattcatcggtcaatggatgagttatttgtgtactttgttccatgaagacatattaagtttcacctaaatctttcactatgtttggattccagtacaaagtagtttttgagatttgagaaaggacaacaatttaattcctatacagatggtgaaattgaaaggcagaagaaacacctgcattttggagagatggagatgagccacaaagtagagagtcagagtgtgtgagaactgtccaataaagccacccaaaatctgaggtgggctgggggatgtgttcagcacatagtacagacaatcccctaattacagttgttcagcttaggattctgcgaccttatgatggtaagaaagtgatacatattcactagaaaccgtacgtcgagtacccacataaccattctgtttctcactttcagtacagtattcaataaattacatgagacagtcaacactttattattataaaataggctttgtattagatgaatttgctcaactgtagcctaatgtgcgtgctctgatcatgtttagtctaggccaagctatgatgttcagtaagttaggtgtattaaatgcatttttcactgggctgtaactccatggtaagtcaagaagcatctgtatttgtttagaaaatacttggattcaatttccaactctaatcttgtgacactttaagacatcctcaattacaaacacacatacacacacacacacgagagagacagagacagagaaacacacatgataatttttttaaaaattaaatgtacttaaatttaaaagatgctgtgcacataatttgtggaaataaatgagagaaatggtttcacaaaacaaatgttgaagaactgtagttatgcaaaaagccaaaagtcagtatttcgtgacatactctttggcctctaagcaggaataacgcactgttttaatcttgtcattttatccattttattttgacccattgcttatactgagttcaaaggtattttgactttataatttttctattttcaatttcattgctgatttgtcaggaaatctctgaggagcccagttttctcctttaactaatagagataagaggatcactcttcccgtctcaaatcatcctctattcacaccaggttaagcctcactatctatatttacattgcactttgcatttttttctatggtacgtttcataatttgaaaacattatttttgtactaatttatctatgagcgattataggacatgttgtaggaaccatgggtgttttgctaacagatgtaggccaagtcaatgagttgctactgcctaactcagtgtagtcacctatggaatagctataaaatgaataaattaataatgaattttttttttaagacaaagtttcactcttgttgcccagaatggagcacaatggcgcgatctcggctcactgcaacctccacctcccgggttcaggcaattctcctgcctcagcctcctgagtagttggaattacaggcatgcaccaccacgcctagctaatttttgcatttttagtagagacggggtttcaccatgttggtcagcctgttctcgaactcctgactttaggtgatccatccgccccagcctcacaaagtgctgggattacaggcgtgagccagcatgcctggccaataatgggattttaatagcacttgttacaaaaatcttcatttttaatgacatttggaactattttttaattcttaaattgtctaacattttatagtaaactttattttacgtcactttctaatgtacgcaagcataacttcagaatttactgagattttttgaatgacttctattaaactaatttaattgcataattttctacgtagcaaagttatttttttccaatttttaaatttctctgattctttaaaattagcattatcaattattttttatgcaagtttataagaagcaactgattcactaatcaggcttatttatgtcaaagtttctaattatttccaatatagtgaggtttttagcttaatttttattagcatttctacaaaactcaatttttctgagtcaaatcactcagattctatttttttgttcaggataaaaatgtacctatgacaagtagtattgggttttataaaaccataatttatatctgatgattatgtcaatctgcaatatgtattgtgaatcactttatttcttggagaaaggaacagggtaaaagtttcagactctgtgaatatctcttagagaaaaaaatatcatagttacataatgatgcaggatctgtggatataataaggtctaaatggcaggactaaatgcgaggactaaagcattctatgcttccacattatacctatgacacaagctttgatatttaaaaataaacaaaaacaaacccagatactcccaaaatatgcacaaaaaacttcagcttttataagaaaaaaagcaaatatcagtttatataataggtttcctaaatgttttgtgagaatctagtttttgtataatatttatatttgtattttcattatttcaaggctgggtttgatgtattggaagcaagggcacagatttggtaaagcagtgaatgcttccaaagacaaaaatttatttctgatataacttttgaagcaatgtgaattttcttctatcaagtttccttaaatcgaaatcaaactataacaatatcttggtttctatgggttctctgtcatgtgcatcctcaagtatatgtgaccaaaggtttttaagccataatatcactattatatcatcacctacctaccataagaatgctaaaaattgtcctctttgagattttgatagtttaatatttctgtgtggaaaaaaaatcaaacccaacaaaagaaaataatatatgataaagaattacaaggccttctatcccaccacttgttataggtttaatggtgtggccctcaaaaggatacactgatgtcctaaccctcagtgcctcagaatgtgaacttatttgaaaatagggtcttggctgggtgcagtggctcatgcatgcaatcccagcactttgggaggccgaggcagggggatcacctgaggtcaggagtttaagatcagcctagcaaatacggtgaaaccacgtctcaactaaaaatacaaaaattagtggagcatggtggtgggtgcctgtaatcccagctacttgggaggctgaggcaggagaatcacttgcaccctggaggcagaggttgcagtgagctgagatcgcaccattgtactccagcctgggcaacaagagtgaatctctgagaaagagaaatggaaggaaggaaggaaggaaggaaggaaggaaggaaggaaggaaggaaggaaggaaggaaggaaggaaggagagagacagagagaaagagagagagaaaagaaggaaagaaagaggaaagaaaagaaagaagggagggaggagggagggaaggaaggaaagaaaatagaaaatagggtctttttagaggtaaaatcaagttaaaatgaggtcattcatgtgggccctaatccaatatgattttttgctctgactaaaagaagaaattgggacaaagagatagacacacacagagggaggaggatgtgaaaatacgcagagaaaccatgtgaagacagagaactggagaaatgcatctgtaagtcaagaaatgcggaagactgcctgcacaccaccagatactaggaagacacaaggaacgatttctctgcagatttcagaagcagagtgaccctgccaacatcttgatttcagatttttagcctctacaactatgaaatgatagtttcttttgctgtaagtcacccagcttttggtactttttgtggtagccctaaacaacaaattcaactctttttccagtattaacagtagtaaaattaaaacaaggataataagaaaagaaaatctacttttctgcttactcttataaaatctgcctagcactcatttctgctgatttgattacatttacatacaattttaattaaagaactactaataaatgtttcaattacaggaaaaaatacacttaatgaagaaattgtctatgatgatgatctgagaagccttttcagaaaatgttgttgatatatttatttttcttttctactattacagagaagactggaggagaaactaattccaagcccccatacatgatcaactgagtcataaatccttccccagtgtaggtgagagttcacagatactactctcataatctctctagtaagtctttccatttctcaatcatttaagcagtagaggacactgtttttatttctttgcattttcaatgtataaatcgtgcaataacacattgttcaattttttctaagttggtttaaatgctgagaattctcctgagttctcttccttggcagaaaaaataaatttctggaatattttcaaaagcatatccttgcaaatggaaatggtaagcttaataaaccatgctgtttgaggtcagccttgctgaatattgctcctcatatcatctttagttatataaggtcataagggatacttacgttcaagatcataaacaaaatgttggtgtagctcagcaatttcttttctatgcttaagaattattttcaaaaacaatatcacttttaacatacttctgattctcttgatgataaccccaggctttgatagtttgtttttcttttcagcttttgcactgggcctttgacatatgaatatacctgtatcactctcataaacttcagaagctttgttgcattttccttcaaattctctctgggtcaacacttaaagtataatccattaaccaagcccttgcaatatccacagtagaaaatgaagataagtaaatattgctgtgattcttttactgacattttttccaattcttacccctttcaaacagcgaatcagttctcgaaatgaaatcaatcttgtagacatgattaccaattataaaaagatgaaattttcaaattttattaattggatcaatttttagtatcattaagattaccttgctttcatttacattaggtgaagttatggtatacaatgacactaataagcaaaggcgagtttaaaataacaagagctaccatttattcaatgtggtattatgtggaaagaaacagtacctgatgctttgcaagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatgctatttcttaatttacctatcaaaaccacttttctctccaaccactcttcccttctcccaatatacttttatatcagtagttgttatccaatgactatgaatttaagtcttttgtttctttgggaacagtgtgtgcatgtaagaagaagcagtacagtataataaagaaggcaggtttgggagccaggctcttggctgcatcactaggtgacctttttgtagcctctttgtgcctcagtttcatcatttgtcaagtagtgcctatcccagcacttactgtgggaattaagtgaagtgattagaacaatgcctgccacatagttggtaatatatgtgttagctgttatccaaatgtatctttcattgaattaaaaatgtaaataaaatatgtcttctactaaaggaattgcacaaattaccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacattaaaatattttccaggcaggtgtggtggctcaagcctgtaatcccagcactgtgggaggccgaggtgggcagatcacttgaggccaggaattcgagaccagcctggccgacatggcaaaccccatcattactaaaaaaatacaaaaattagctagatgtgatcccagctgcttgggaggctaagtcacgagaactgcttgagcccaggaggcagaggttgcagtgagccaagatcacgccaccacactccagcctgggtgacagagtgagactctgtcaaaaggacggaaggaaggaaggaaataaaatattttccattgattacccatgctttttattttgaattaatagtgttcgatgcattattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctatattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactgtaaaagtacacttttttaatgcaacagcaggcatacattttttccagtttgatgtaggcaggacctcaaataatgtcaaagtaaagatggtcaatctattcactattggaggaaaacattcactgtgtatcagcttgagttggagaaattacagttaagaaatgttttgtaactaatgatggcttccacgtttgtaaatcaatgactcataatgtatacatgtaaacctatatttcattattttgttagtaaaccccattataacatatactttaaccctattattcaatataaaatggcaaatgcatttttatgattcatttgtcgtattgttattttactcaagatttgttcaaatgttttactttttgtaagttaaactttctatgcttaaggagtatatagctacaagaaacagataaacactaaaaattacagttctaagacttagttgaatatctttcagtaatttcccttagagatatggtcacactgaccaagctacataaatatattttttaaaatttagtataccaatgtgtctattcatgataggttgtgtttttctccttgtacctaaaagtttgatggtttcttttccactctgtctctctctctctcttattgagctacctcgtactagtcctgcctaaagttttatattgtttctattctaactatactcagaaatacataatttgaaacttgaatataacctcttttgtatttctaatttttggtgagcattattctggttgttagccccttgaaggcaggtactttgtgttacattcccaatttatctgacaaaatatttagttcagcataaataatatgcttagcattcaagatataatttgtgattaatttattttgctttataagaggaattctgggggtagcatacacgccaatcatccttgaaatatatataaactacagtgcctctagagtgttatagaaaagccagtggattaaacatcaaaacctcttagagtctctgaatcatattattctattacttctcttattttctttatctatctttgtctcctattataagaaagaagacataaagatataaaaaacttttcctacctctgccttgaagaaagtttaactataaccttcataattatgaccagggacaagttaatgacagattccagctttggtatggctaaggtagaccactcaagggatcaactaactaatatcaaggacagtaaggttcttaccccattcatgagcttcaagtgttctatctcaccccaaaagagattataactctttttttacaatttcattttataatataaaccactatttaacctatatttctgaatcactggactgaataattttatatcaatttattccaactgctatgaatactgaaagtgcatgaatggaagatggcggcccatgaggcaggccttgttaacagtgtttccccagcagaagggtaaaacacaaataatccctccagagaatcaatttgcaaaaggagctcttcaaggttctgaactcctttccttgctctgctgtactaattagatctgacctaacaatgattctgcttatcttggcgttgtgtcactacccttagctatactttaaattaagaaactaacataatttattttgagttactagtacaaaagaaagtaatcttcttgatgggattcagtttgaggcagtaggttctgtataaaaatttttatcgtagatacaattgtcacctgttttctagaaaaaatatattaaatataacctaatgaatatgccaaacttactaggtctgtatttttgctttatataaaatgtcatcaaatttaaatataattcccaataaagtccacatctctgaattatctattacttgcattttggggtgtgtttatactacctagaatgttaacccttattgtgccttaaatgtgcatttgtaaaatgtaggcacttttataactatgagtgaggctggtaaggtagtgtttaggattctccatgtcagttagtgaaagtaagaagtacagtgttaaaactattgtaaatagtttccggggcaagtatagactgagtccatccagaatgactgtaaccaatttgacatcatgttatggataaagaagcaatgaaaaataaaccaaatagctacattatatcatattcttaactttcataagccatgttttatggaaaactttttagttttctcaaaaggctaatatatttcaatattttgaatacatcattgttaattttgagttggcagaggtaaattaaccaactaccattacgttttaggattaagagatatagcttttaataaagttactgaaatgcaaaaaaaaagagaaactaacataagttaaaattgattgtacatagtgtcaagacagcaaactcaaatgtctaaaaggaccagggagaaaatgtcaataaataaatgtttgtgttcaaggaaacccaaaactagagcaattgagggcccacacaatctaagcatagtgttttctgactcttgatgcatcaataaaatacttggcctctgataattttattttataagataaaccagtatataacctatagttcaagatcactggacttcacacttttataacgatttactcaggtaactaaaatatttcttcgctgagaagatcaccctactgcctcactttcaacacattaattaaagatcttagaaccataacaagctttaaggacttactaaacaattaggcaagaaattacaattttgccagtcatcccaggtaatcataccatcctgactcataaaatttccttatgaacatattgacaacttttaggaaaaaatctttctaacagactgcttgggaaaattcataatgtctctggcctggtcacacagcttaagtactttccgtagaaaatattcatgggatttatagaaagtcagtctacagtgtttacagattaagaatcagacaatcagggtcctcttcatggaaaatgaggatctatttacagtttatcaataatcagagatgctacgaagttgttagaatgagctaggtgtagccttgaggacttagtaaaagtcctcaaaggaaacttaagcataagcagagtaacttctctctgaagaataaatcaggatacttcctgatgtctaccgaaggtcccttgaagccataagcccaaacatttttaaattatttctgtcccaaatcctctcgctaaggaattaatgtcatcctttaaagatttagcatcatatgaatggagaagagccaggtaggtgctttcctagagagaaaaaataaatcaaacacaattcatactttattccagaaattaagtgttaacatgtcaaatgcttttgtctttaatttgaatgtctttcccttcataattatgtagagcagaggtttagtatttttgaggctattaaaattcctgagataaacttgatttttctctatgccgtcacgctccagaaaacataagaagaatgttaattctaacctaaaagaacccaactacttctgtggataatcagtttaaacatccatgggtcagaggaggggatgacagtttattgtgataaacacatgtctaagagaaccagatcaaggtcactgacatgtttaatattaattgctaaacaactgtcagatggcaatggtttgagttcaccacctctcatgagttgaatccaaattgctctctgaaggagaaatcatctactaaattctgttctttcaacaatgaaaacaggcatacctgtcaattttctatataaaaaataccattgtgtttattcactcacgtggattttcagctctgccaattcaatttcttcactgaacctactagtatacgcctcttcaatatagtcacgttcaaataaataagagtaatattctcattgagaaagggatatatacctcagataaattcattgttccctcttaccctctgttgttgataaatttagtttccaaacattctaaagcaatcttttgaaatcatctgttggcttgagtacaaagaacatgaggtccaactaattccaagcatttctttaatatggtaaaggtgttgctttgattgttactctcagccacgaactaccattggatcatttaattccttcaaaagcaattgaaggactggcttcaaacctttcaaaatctgttttcatatctacatatactgagaggaatagagagaagtttctgaataaaataataatactttgcagttctctgaaacttgagagggaaccagagaatgtttattactgagttttaatgtcttttaaagagccaacacctgatacttcaaaaacgttaatcactccaataaacattttactcccagaaattcatcttaaatccatcttataacataaacaagcctagtaagtagcattattaggagaaatttctggctgagttccacacatatattcaacttcctgaacaccctctaaaagcaattttaccttacttgacacaatacagaaattaatcagcataataagtaagctaaaacttcaataaaagtgtttgcatcttgtccaggcaggtggctcatgcctgtaatcccagcactttgggaggactaggcaggtggatcaagaggtcaggagatgaagaccatcctggccaacatggtgaaaccctgtctctaccaaaatacaaaaaatgagccagatgtggtggtgcacacctgtagtcccagctactcgggaggctgaggcaggggaatcagttgaactcgagaggcggtgattgcagtgagctgagatcacaccactgcactccagcctggtgaaaaagtgagactccgtctcaaaaaaaaaaaagtgtatcttaatttgaaaatattcataaagaaaagtgtaccctggtaagggggacagataacctaaaagaattatagggggaagagttttacatatataatgatcacattttaaaaattatagttgacctgcagataaataaagtatggtgtttttgcctttattccttaaatataatacatatcctttctctcaatgaccggctaatccaacactgatgattccttgaaacatccctgtgacttaaagtttacaatttctaagaacttttcctaactcaccatctctcagttattcacacacttaaattttcttttatcctattgaaatcatgcaagtattgtctgcaaccaagataggtaaacatatcttctagaccactagaacacatggctgttttccagatatacaataagtgatgtcacagacaaagaatcaagatacacacttctctttaccactgaaaatgttcacctcacatttttatctcaacttaggtgggtgtgtttttgttttttgattttgtttttcctacttatgaaaatagtgccaaagatcttcagttggcactccaaagcacagacaattgcaaccaatgttctagagttacttctgaatattatcctagacaagtagcaggagcactgacatgttttcataagagaataaaagacatacaaagatttattatctggcttcataaatttaaagcaactgtagtgccttgaatgtctttgtataaacttttatatgactctaaaagaagataaaaatctaatagagactttcagaaggtcaaatatgaaagatgatcatgtctaatgaataaattgatttctgctggagtaaataggtcacaattccaaaaagaatctgtattattttttgacagtgcacctaaagtaaaaatgtggctccatattatgtaagattttggtacaatatttaaaattctaaaatcattaagcaattccaacctatacagaagtatgacaccttgggattatctagactatatggctaactcttttaattgtatacagatgttaagtcttacctctgcatgtgtgcattgagaaaccagatgaaaaaaaaaacttaactgtacttttcaaaaaacttggttagatatttttatttaaacatttggttttgtacagtatacatttaaattacattgcttaatgaatccatctgaaaacagtcactggttgcttctgtgatttgtgaataggagaacatataaatatagcagaatgactttgtctagcaacatgttcttgccaagataattgggaattaaatatttaaatacatggaaataatatctttgcggttacatatgtgacttccaaatcagaccaaactaattccttaggaaggccaagagatagtgaagccatagcatcagagtgacacccagaaattacagacgacaagcattatgcaaaggcatagaaaatttgagattttggttttaagaaattttcctctttgtaagtcaatgtcttagtaaacaggaactatgtattcattacaaacatattgatagatgtgtatgtgtgggcattcatgtgtgtgtatacatgactataattcacaatttaatttgggtagataaatagatattgtatagatccacatatactttcatttggctatatataaaatatatatacataatatatagaatttcatctggttattatattaatataccataaataataagagtgtgtgtgtgtgtgtgtgagcgcatgtgtgtgtgtgtgaaatttagctataaactttgagaggggaaagagaaagcaaaaaaaaaaagaaaaggaaaagttaaacctcagaagagaatacactgatctagtgagtttttttaaatcttgaaaaaatggttttaaatttttgtttgatacttttgtaatctcaaagctgtcgcaataacatatagtggttttgaattgaaaaataaaaagataattgcctgcgctcagaagctggagatcagtttgggcaacacagtgagatctcacctgtacaataacatattttaaaaaattagccattggagcagtgcatgcctgtagtcccagctacatgggaggctgagtcgggaggatggcttgagcctgggggactgaagctggagtgagccatcactgcctcattgcaactcaagccagggtgacagcaacaccttgtctcaaaaaaaaaaagatattaatggcttaaatatgcataatctcatgtttgttaaatgatgcacagccatgaatttactatcaataaatatttttaccattttcttttttgttatcttttagatctccatcaaaataaacataagtaaattaattctttatctttacttttgcactatcttctctcgtttatagctttatcttttcaatcagtttctagcttcctttggttttattagtaatgtattacatttgcatagcattatgtattatattgaacaatataaaagtgccttttataagtaaaaatcgttgattattagcaatttcatatggcttaaacttaactcttctcaaagtgcatttttatgaattccctcatttgatcatcaaccttgttataagattaatactcaggttacacaaaagaaaataaggtttcaaagagttattactaagtctgaatcagctagatatgttaaagtactggtgcattgattgtagattaaagatgtgaacatgcatatacaaaggcattgtcctgaaattggttttaattaaaagctcaaaatccacatttccatcttcccgccacaatctcttaccccactaaaaagttatcatgatgattaacatggggccttacttcactgaactactaattattcttttcagtgcttcttttattattatgactttaacaatacatcttctgatcttactaatatattttttattaagaagcttagttgtttctaccaagattaaagaggagatcatagccaagtttcttttaaaaatgaagactgcttattcttagcaagaggagaaaaaattgagggcaaaattttgtggaaatttaatttgcctcatttgtccacagtaggtaagtatggcaactgtatgcaaaatgcagcagccacgcatttcatcagtgataatatgtgactagactttctaccctctctgtttgtttttgtttttgtttggtagaggtagcacctcccagtgttgctcaggctgttcttgaactcctggcctcaaggaatcctcctgccttgtcctcccaaagtgctgggattacagatgtgagctgccacacctgcctttcttctcaattttttaatcaatataaattataaaatgtggttcacaactaaggttgaaaaatatctagtccttcaccccttaccccttctcattccccaaaccctgtgaatctactgtaaaatgaattcataaaccaagagtcattgcttttttattctactgcttacattttacttggcaaacacagaaagaagttgggtagtacctcatggaagaacaaaaaagaagaaccctggggaacaatttctgggagtatatcataccacatgaaatctggaaaactccttcattctcatctgtcttttttccattctaaatcaacacactaattggataaaattttgcccagttaacttatacttcctgcaaatattacttcaaggatctcacttaaaaatgtaaaataattaaatccccccacaaaaagaaataatttaaaaatatacaaaggtatttgatacattttattcttattctctcaaaattattatattttgagcagaattattatattgaaattctgtattttccttacttagcattgcactgggaataagctggacaccatctgtttgattcaattgtttacctcaaaggggaagtaagttctagaaaacaactctgaaaaactgtgtagatgaactttctgattctacgacatagaataaggagctatatagagaattcttagaactatgtcatagaatcagaaaatgtataaggcagaattcttagaattatgttgcaatcagatgaactgacatactcttttttttttcctttttgcctcttcgctttacaatcaagttaaaccaatttaccttgactgtgtttgcactattcctacttcatctttattgagtaattatgttccttctcatgacaacaaaactacattttgaaaccttctcatttaaagcaggtacacaagacaagacagacaccgatctccagtgcagaggtgcattggacaatgtgacaagggacgcagtggtaattataaaagatctgttgacattatgtcttttctaaatcccattagaatgatgcattttaaacttattatttgatcaggatgaggagagtaagataattaaaatctttacagtacctatatttcatatactaaaacacagtaacaatatgtgagaattatatttcaagcattgggtcatttctgtgtcttataagtctctttgctatttaagaacccatggtatttttttatttctatttctatttcaaatattaaaatgtttatacccatatgtctatttcagaagaggtattgtaaaatgatttaaaattttgtggtcccttaataaattctatataaaaagcatagattaaagtggtcaggactatttaaaaaccagtatttgtgtgtatgtatatgtgtgtattttaagagagtgaatatccatgaaacatatcctcataaactggcctaactggtcttcatagaaaagcattattttcacgctattttatctatagaattaattgttttgcatagtcatagaattttctatatacaagaatccccagtgcccatcttcctacaagttaaataatgcataagtgtatcctgaaaaatgctagaatatctctcttcagagaacccatgtaaataaattagctcatattcttggaaaacagccttgctgtgtctgtgtgttctccttcaccacacctggacagacctcaactcgtaaacaaacatcctaagatcttaagtataattagtgcaaccaaaacacttgaatatcaatattattctttttaattgcattagcttaaaatattgtatctttttgttgtctaagaaccagagccctatggttttctcttaatgttaaattgtctataataatgagtcaaagtcatattagaaaatattagtactcacatggccattatctattatgccccattgatgaacgctttgggagggtgatgttaaatcttcttctattttatttaggaatctcattggatatcatagcacagtctacacatttcagtgtctcctgggtggcagacctcacagaatgaagccaggagccttatgctgagagaataggaatgttcaatgggttcttccttcatcaagaaaaaaagcacccagaaaacaaatagctaacagccatcttgaagctatcttgtgtgcttgtctcagtaaaaaaactaaacagaaggaggaaaaaacaaacttgacatggttaaaaagcagaggctgctcatctggatttatcttgcgttatgcttttttaatcaaaaattcttcaaagcttactgattgtttggttcatgaggtgaagggcctgtatcttcaaagaaagaagaggcaagatctgctaaaagagaaagcctctcgtgatgatgtacttactgccactcagaccagaaaagattctggccctgatgcagttaatcacttgggccatgagttggtcactgctgtatcctacggagagcctgaacaagtagaacttttgttgagtcattcaactgtagaatttctgcttcaaaggcaacaaagtcctttcctccaagatattaaaacatagactaaccaggaatgatttatgtattttaagatacaaataatacggatttttttaacactattactaaattatgtttaaggtctttgagtttaaaactgttaggaggactctcaggctatataaattacacagggctctcggagatcacaaactgtctaaagaaaaagggtcatgaggaaggcaccatctctccccatgttttcatgactgaatttccataatttatttagtttctaccaatgacagaaggcgggtggaggaaggaacaagaaagctatcttaaaaggagatacaacagagtaaatattttcccagttagaatcttagtgactttgaggggattaaaagaacctactgtgaataattatacatcaataacttggataatccagaaaaagtatataaattcctagaaacatacaacctatcaactgaatcatgaatataaaatctgaacagttcattaactattaaggagattaaatcagtaattaaaagcctcccaaaaaagaaaagcccagatgagatggttgcactggagaattacacaaaacaataaaaaaaaatagtgctaattcttctcagaattttctaagaaatagaagagaagagaacatttccatacttattttatgaggccagcattgtggtgatagggataccaaagctagacaaggactacaagaaaagaaaacaacaggccaatatccctagtgaacacagatgcaaaaattcacaacaaaatactaacaaagcaaatttaacagcatattaaaagtatcatacatcatgacgaagagggatctattcctgggttgcagggatggttcaacataccaaaagcaaatcaatgtaatacaccacattagtagaataaagagtgatcatctcaatagatgcagggggtaaaaaagtattttactaaattcaaccccttttcatgataaaaacacttaacaaactaggaatagaaaaattacttcaacataataaaggccatatgtgaaaaacccagagctaacaacatactcaaaggtgaaaaactaagagctcttcctggataatcaggaacaaggtattaatgctcactcttgccacttctattcaagatagtattggaagtcccagctagagcaatgaagtaagaaagataaataaaatgcatcaaagccagcaaaaagtaaaaaaaatctctgtttgcagatggcttgattttatatgtagaaaaccctaaagactccatagcaaaaaaaaaaaaaaaaaaaagttggaactaataagcaaaaaagttgcaggatacaaagtcaacatacaaaaacaattgtttttttttttattcctgaaaaaaagatattaatagtttgataaggattgcattgaatctgctgattgctttagatagtttggacatcttaacaatattaagcattccaatttggaaacacaggatgcctttctatttatctgtgtcttatttaatcagtatataagttttcagtatataggtctttcaactccttgggtaagtttatcactaactgttttattatttttgttgatattataaataaaattggtttaattttttatttttttattgtatatatccatatgcaaaagattgaaactggatccttatcttacacacaaaaatcaactcataatagattaaagacctaaacataagacctgcaactgtaaaatgcctaaaataaaacacaggtgaaaagctttaaaacattgctcttggcaatgatttcctgaatacgacaccaaaagtacagaaaagaggaaaattggacaaataagactacattaaactaaaaagcatatgtgcagtaaaggaaatgagtgaaaaggcaatctatggaatgagagaaaatatatgcaaaccatatatcttataagaaatcaataaccaaaatatataaaaaactccataactcaatggcagaaacacaacttgattaaaaagcgggcaaagaacttgtttagacatttgttccaagaaatacaaatggccaacaagtatataaaaagatgatcaatatcagtaatcaagcaaggaaatgcaaatcaaaaccacaaggaggagggaaagcaatgcgatatcaaccgacacctgttacgatggccataaccaaaacacaaaataacaactgtcagcaaggatgggaagacattggaacccttgtgcacttttggtgagaatgtaaaatggtgcagccactgtgtgaaacagtatggaggttcctcaaacaattaaaaatagaactaccatatgattcagtatttaccatgtgatttctggtattcacccaaaggaactgaaaactaggaccctgaagaggcatctgcacttctgtgttcgttgcagcattactcgcaatagccaaagggcagaaacaacctgtgtccattgacagataaatggaaaaagaaaatgtggtatgtacatacaatgaaatattattcttccttagagaaataggaacatcttgttatatgctacaacataaaccttgaggatatcatgctaagtgaaagaaaccagtcacaggagacaaacattgcatgattccacttctatgaggtacctaaaatgatcaagttcatataagtagaaagtagaacagtagctgacaggggataatagggcatagggaagatagggagttgctgttcaatgggtagagagtttcagtcacgcaaggtgaaaaaagttctagagatcttccctacaacaatgttcatattattaacaatagagtcctgcacacttagcaatttgttaagaggataaattacatgttatgtttttttttaaatctcaatcaaaggaaagaaaaaaagaatcttagtgatttttagagcagtgattatttccctgaattatttccatgttcaccccatcattaaaaaaagaaaaatccttggttgttcattcaaccacagagaagtggttataaatcccaacatattggtactttactgttaacactgacttgagcagacatcactcatgataattcctgtgtttgccatttgcattgtatcaccctgacttgtcctggtacgcaccagcaccactctgctcacttgttaatacacacattttccactgcacatgttggttacaggtcactttttccttaaatttaattgcaacacttaagcatggactaaccaggactcatgtttttattaatacatttttaagaacccatgattgatattcttttagccctggggatggggatatgaaaaaaaacaagaatcatgaagtggtccagaaaattgctctggaccatcctgatttctctcctgtattaattcctattgaacttactatcctttctattgaattttagtgcagaattgctttctgatagtgtctatctttattctctttccccattaaatcatctcactgttaccttactttctaacaccacttcctgcacaggtgttgtgtgtcccataatctcattgcttgagtgatttgaactaatttaactcacatgactgacagttcagtggagggtgtccttttgacagggtggagaagaagcttgactgtaatattgctcagctgtactgctatggacctcatttaagaccacaaacactttttcaatgatttatttaactttttgaacagataatatattcacaaagctcaaaaactaaaaagcacaaaaagatgtgtgctgcaatgtttccaacctattcttgtttgccgtctgcctttcatcctcgctctaccctccatccaggtgaccctgggatgtagacagcagtacctaaagtttcccagacgcttctaaagcagaacattgttgttttcagttgtaaacaaggaggagcctggtgtgatttcaggttccagtttccagatgtcgcctctctgtcagggatcaaaaccacttacagtgccaatttcacttgtcaagcaatcaaacactaaataaacaaaccaaatggatactgaacacccacgaggtctgtttgtgttatagattatggagaggatagggataaacaagtaaattattaatcttgaaacagatatgtggaaaaccatatctacattaaattgtcaataaaactgcattttctaattaagcaggtgtgagatttccatatatgcattcacccccaacaacatatttatttaggacttggcagaagtttaggtgtcatcaatgagaatccactcatttaactaatgagaaaactgaagttcagagatgcatcagggtttataattaagaatatgaagagtatggatccagccagacttggtttaatccaagcttgtccaacccacggcccacaggccccatgcagcccaggatggttttgaatgcagcccaacacaaattcttaaagtttcttaaaacattatagatttttttgcaacattttttaagctcatcagctatcgttagtgtattttatatgtggcccaagacaattcttcttcttccaatgtggtgaagggaaaccaaaagattggacacccctggcttaatcctaccacttagcagctgtgtgacattagacaaactacataactcctatgtgcttaaatcttcccatctgcaaaatggaaataagaatatatccttcataagactgtagtgattaagtgagttaacatatgtaaatagctaagaaggatgcttgacatagaataagcaccatagaagtgcaagctgttataggttaagtgtcttgtgaaagatgagaacagctgggagagtctagagagggttacatgctgataaaatgatgtactgaattatccattacaaagcattagaggaaaataaaattcataataaggtaatgtgcacattgcacacgtgaaaaaagaatttaagaaggctggagtaaaataagcaaattacactgatttagctcataaacaaggaaataaaaaaatcaataaggtggacaaataagtaggctctcataagcatcactgggccaggacaaaggtctcagagactccaaatctactcagttctggaaatgcttcctttatttatttatttatttttaattttctgagggaaaatacagaatgaaaaggacgtatactcacaggtaagtgccaaatgttttgataggaaaacattttaaacactaattgactttgaatcacgtttgagtaaattttggtcttcattgtatttaagtgatagtctaattactacctatgatttcagaacttttaccaaataagaaaataaaaacaattagctattgctcatctttttctatgtgagtgctaacataaatttttaaaatataaaacaaagtgaaagattagtataattttgcttttcattttaaaataaatatagctttccgtttaaactgtcttcagatacatttctctcagtatctaaaacaattactaaacaagatacgtttcaaagtaagaagtcatgcttttattaaagagaaaatggataataatgttcacaagtaccactgattcacaatttctagattagttatatttaagtgattgaacaacaaataaggaaagtcttaaaaataaatatttttctgcagaaaatacacaaatatattccactcttgagagatctcacctttgcataatataagacactcatctgatgcagttagcctatagatcctttaatgaccttacagccaaatctaatcaagcttagattgcaacagaaagtaaaggacacactcctattttatcaaaatgtgaatgctgagaaaaagagaagagggaataatatgccttttaaatttatgataagataattagcaaccttgctaatgtagttcttcaaacattaaatcctcgttttcattcttcttccctaccaaatttaatatactatgagaactctttagcttaattatgaaaataataataatagagttaagggtctgtcaatccagcttaagcccctatctagaatttagaacctggcatcctaattaaactgcaaatactttatttacaaagttattgtttatacattgtaatgaattaatctgattgaatctctgactgattatgggctaccatgtatattttcaaagcaatgagaggggcatacaattgcatttccaacattcagtcgctcagcataattagagaaagtaactatagacgtcaataatcaatgtgcacttgcaccctggagacctgggcaccattacgattccaggaacctctttgagttgtcattttaattatttgcatattaagatctctgcaggcaggcaatacttcaaaagataggccaaaacagctccttcaaatgttattaagttcaacattgccaaatatattttagttgccaattttgaaaaccaaagagattatttaaagtctatcacaaaactgttacagtgagaagactgagttaactacctgtgaccctaggccatcagtgcagacctggggttgctgaagatttggaaaagtgaatcaaaatttttttttctggaaaaaataataaaaagtaacaatacctaccatcatacaactacaataaaataaatgctttacaaataatgtcaaataatagatactccataaattctggtgaatctttgttattataagtagtagcagaggcaacatcaacattcacattcctgattcccatagcactgctttttctatgaattaatgttgtttcctcaactagactgaagaattaataaaaagtcctattttaccttaagtacaaagtgttttgtctacatgctaattaagtacgccaaattgttttctatgcttctagaagacaaataatgatttatgggtcctaaagagcacttggaatagtgctggatccacagtaaatgtccagtaattggttatttattgcttgatataagtaagcacacaaaatgaaggattcaatgttaaagaatcaaacagagatttatgagtgtgatcaaacagagttactatgttggaggtaaatttaattcttgtatatttcaaatatatgtcaaatatttctgggacattttgaattgactttcctctctgtgaatggcaacactacccaacatctatggtaagcctcattttctcttatccccaacaatgcctcacacacacaatgaacaagaaatgagaaacaatgtggtcaggctttctgtcataaaatctgattatagagcaggatttgctatgcagaagaatttagaggaagtcagagccacaaagtgtggctgtgccaccaaactacatttttttcacacacaaaaaagagaaagtagaataagaggctgaatggaaaggagaaataacatagacagtactgagtacttgttaacatccaatatataaaagagctacctgaataaacagagaaaaatatgactatagtattattattgctacaattcaaaccctttgagtgtgtgtgtgtgtgtgtgtgtgtgaaaaatagatacacaaaaatatcaaatgtggctatttatagatcttaaatacttaaagggtatgattattacaccttggctccttctcactcacattttaaagatgtagggaaaggtgatgcctaaaaagactaccattcctaaaatcttatgatttcacaattttctgcatagaagtagttgcttttaaaactctagtatgtatttgagctgtatgactccctgagaatggaatatgctaggatccagtaaagggatattgaggtttggcctaagggctaaacaaataaatacgttgaggccagaggcatagtcaaaggttagctccttggtaagaaaatagataatccccctctgaaaactccaggtgaatctagggcccagaaaaaaatacccacttctccagggtcatgcaaggctaaaacagaccagcctaggagcatggatacaaactggactagcaagcaccacaacctcagaaattagaatttggtgaggcagcttttcattagtaagatgaataacaagagggaatacttgttttaaaattgcatcaagctaactgaaaaagaaagattaggtgcaggcatccacaatttgttattatgtttttcaatcttggagaccggaattctcctgtgctttgaattaacagcacgcaagtgatacactatagagaagaaaagtcaaaaaattagtaaatcaatagggctgcctttatataacttgccaccataatttttccctggatgcttccaacgtatctatagttttgtttattcatttggcaaaatagggcacccacatccttggcacagttcatgggcttgaattgtaaccgggaagaagacaaatataattcctgctgtgatactgtgatttaaaatgagatatatacatttggtcttcactcccttctcctgacatataactcttaaaatctttgaaatctctggagtgataagaatatcatttgtatgctaatgaatgtttgctggctggcagcctctagatagcttcagaatgggggccagtcaccaagaccaagacagaattagagggttaaaactttcagccccaccaccaacatccaagtaggtgagaaaggctgaaagctaagttgataaccaatgaccaatgatttaatcaatcaggcctatgtaatgaagcttccataataactcaaaaggactggagtcagggagcttcctgacagctgaacatgtggaggatcccagagagagtatggcagctctgtgccccttcttccgtacatcttcatctgactgtttatctgtatcctttgtaatattctttataataatcaagccaaatgtaaagtattaagtgtttccctgacttctgtgagctgctctcgcaaattaatggaacccaaggatggggtctacagccagtcagtcaaaacctgtgcttgcaactggcattggaagtcggtcgggaggcactcttctgaaaatgatccttcaacttaagggatctaacactttctgctgctagactgtgtctgaattgacttaaattagagaacacttggcaggtgtctgttggagaactgctggcttgatgtttgggggaaaacccccacacatctcatgttagaggtattgtgttggctctgcaagagtaggaaagccactttgactcttcccacatatcttacatctgctctcatggaaattacagtggctatagacagagaatgaattcttaaacttaagaaaaacaatatagtttcagagagtgatccatgattggagctgtaaagaaaccagaagatgtggttgagagggactgggggaagggaaagaggggccacaggttggtggattctttaattagatgggctaattggaacatcctcactaaaaaggtagcatctgagctgagagtgaaatgacaagaacaagctagtcatgtaatcttctggggacagttttacaaataaaagtaaaaacaagtatgaaagccccaactaggaacaacttaaagtatgtaagaaaagcaaagacaggtaaagccaatgagccagtgaaggaaagtgaggtatgatgcagcctggagtcacagatcatttggcctgaaaaaggagttgaaatttagacattagatgaaaagactattctagccatcttgctactagatgatggtggcctgactaatgcatcacctgtgaaaatgaaaagacccatataaattcgggatacattttggaagtgaccctaagtaatccttcaattgttggggtgattatgtatgtttgtgttttaaagtgcggttcagtgagggatcagatgactcctaggtgtatttcgcttgaacaacaaggcatatactaatgatatctattgagaagaaacttcggcagaaattatgaactagaaaatggagaatggatagctctgttttggtcttgagaagtttgagatagctcttagacatcccagtggaaaggtcaagcagagggttttttacataaattaggagctcattgcagagatcaggattagagatatacatttgggattcatcagcatttagatggcattaaacgccacagtactgaatcaccttcagaaagattacagtctttcagaccagcatttggaagccaacagagcagaagtcagcaagaaaggccaagaagagcagtaggtatggaggagaacatagcatcatgatgccacagcagaaagtgtttgaagaagaaaagaactgtcaactttgtgacttgctaccgctgagtaaaaaaatgaggacagaaatgtgatcactggatttggcgcatagtgaccttggtaacagtctattcaatcaagaatggcaaatagcctggaagaaactgttgaggtcgatgcgtatgatacaatgaattaaaatacatcaatatttctagcaaagaaatactatcatttttacctatacttcaattcatccctgatttcatgaatatcacaatatagaatttggttataatttattgtttcatagcagttagttttttgaagctgtgaaaactcacaataattagcagcaaataattaatgtgcttataaaatactctggg

SEQ ID NO: 640 - DNA, 566718 bp, Homo sapiens
aaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaata
